US011261435B2

(12) United States Patent
Tan

(10) Patent No.: US 11,261,435 B2
(45) Date of Patent: Mar. 1, 2022

(54) CHEMICAL-INDUCIBLE GENOME ENGINEERING TECHNOLOGY

(71) Applicants: AGENCY FOR SCIENCE, TECHNOLOGY AND RESEARCH, Singapore (SG); NANYANG TECHNOLOGICAL UNIVERSITY, Singapore (SG)

(72) Inventor: Meng How Tan, Singapore (SG)

(73) Assignees: AGENCY FOR SCIENCE, TECHNOLOGY AND RESEARCH, Singapore (SG); NANYANG TECHNOLOGICAL UNIVERSITY, Singapore (SG)

( * ) Notice: Subject to any disclaimer, the term of this patent is extended or adjusted under 35 U.S.C. 154(b) by 84 days.

(21) Appl. No.: 15/773,995

(22) PCT Filed: Nov. 7, 2016

(86) PCT No.: PCT/SG2016/050549
§ 371 (c)(1),
(2) Date: May 4, 2018

(87) PCT Pub. No.: WO2017/078631
PCT Pub. Date: May 11, 2017

(65) Prior Publication Data
US 2019/0382740 A1 Dec. 19, 2019

(30) Foreign Application Priority Data

Nov. 5, 2015 (SG) .......................... 10201509153Y

(51) Int. Cl.
*C12N 9/22* (2006.01)
*C07K 14/72* (2006.01)
*C12N 15/11* (2006.01)

(52) U.S. Cl.
CPC .............. *C12N 9/22* (2013.01); *C07K 14/721* (2013.01); *C12N 15/11* (2013.01); *C12N 2310/20* (2017.05); *C12N 2800/80* (2013.01)

(58) Field of Classification Search
None
See application file for complete search history.

(56) References Cited

U.S. PATENT DOCUMENTS 7,192,739 B2 * 3/2007 Liu .................. C07H 21/04
435/69.1

FOREIGN PATENT DOCUMENTS

| WO | 2014018423 A2 | 1/2014 |
| WO | WO 2014/018423 A2 | 1/2014 |
| WO | 2015089427 A1 | 6/2015 |
| WO | WO 2015/089427 A1 | 6/2015 |
| WO | 2016106244 A1 | 6/2016 |
| WO | WO 2016/106244 A1 | 6/2016 |
| WO | 2017064566 A2 | 4/2017 |

OTHER PUBLICATIONS

Davis et al., "Small Molecule-Triggered Cas9 Protein with Improved Genome-Editing Specificity", Nat Chem Biol. May 2015 ; 11(5): 316-318. doi: 10.1038/nchembio.1793.*
PCT Notification of the "International Preliminary Report on Patentability" for Counterpart PCT Application No. PCT/SG2016/050549; dated May 8, 2018; 10 pp.
IP Office of Singapore—Notification of Transmittal of the International Search Reports the Written Opinion of the International Searching Authority, or the Declaration, with the International Search Report & Written Opinion dated Jan. 18, 2017 for International Application No. PCT/SG2016/050549 (15 pgs).
Cadinanos, et al., "Generation of an inducible and optimized piggyback transposon system." *Nucleic Acids Res.*, Jun. 18, 2007, vol. 25, No. 12, pp. e87:1-8.
Feil, et al., "Regulation of Cre recombinase activity by mutated estrogen receptor ligand-binding domains." *Biochem Biophys Res Commun.*, Aug. 28, 1997, vol. 237, No. 3, pp. 752-757.
Hirrlinger, et al., "Split-CreERT2: Temporal Control of DNA Recombination Mediated by Split-Cre Protein Fragment Complementation." *PLoS One*, Dec. 16, 2009, vol. 4, No. 12, pp. E8354:1-8.
Liu, et al., "A chemical-inducible CRISPR-Cas9 system for rapid control of genome editing." *Nat Chem Biol.*, Sep. 12, 2016, vol. 12, No. 11, pp. 980-987.
Nguyen, et al., "Ligand-binding domains of nuclear receptors facilitate tight control of split CRISPR activity." *Nat Commun.*, Jul. 1, 2016, vol. 7, pp. 12009: 1-10.
Oakes, et al., "Profiling of engineering hotspots identifies an allosteric CRISPR-Cas9 switch." *Nat Biotechnol.*, May 2, 2016, vol. 34, No. 6, pp. 646-651.
Zetsche, et al., A Split-Cas9 Architecture for Inducible Genome Editing and Transcription Modulation. *Nat Biotechnol.*, Feb. 2, 2015, vol. 33, No. 2, pp. 139-142.
The Written Opinion for Singapore Application No. 11201803151P dated Aug. 15, 2019, 9 pages.
Oakes et al., "Profiling of engineering hotspots identifies an allosteric CRISPR-Cas9 switch", Nat. Biotechnol., Jun. 2016, 14 pages.
Cadiñanos et al., "Generation of an inducible and optimized piggyBac transposon system", Nucleic Acids Research, Jun. 18, 2007, 8 pages.
Hirrlinger et al., "Split-CreERT2: Temporal Control of DNA Recombination Mediated by Split-Cre Protein Fragment Complementation", PLoS ONE, Dec. 16, 2009, 8 pages.
Zetsche et al., "A split-Cas9 architecture for inducible genome editing and transcription modulation", Nature Biotechnology, Feb. 2, 2015, 4 pages.

(Continued)

*Primary Examiner* — Suzanne M Noakes
(74) *Attorney, Agent, or Firm* — Womble Bond Dickinson (US) LLP

(57) ABSTRACT

The present disclosure refers to an endonuclease-based gene editing construct, wherein the construct comprises a CRISPR-associated endonuclease (such as Cas9 or Cpf1) or a derivative thereof and at least one or more hormone binding domains of the estrogen receptor (ERT2) or derivatives thereof. The present disclosure also describes a method of editing a genome of a host cell using the construct as disclosed herein, the method comprising transfecting the host cell with the nucleic acid sequence as defined herein and incubating the cell with an inducing agent.

14 Claims, 35 Drawing Sheets

Specification includes a Sequence Listing.

(56) References Cited

OTHER PUBLICATIONS

Feil et al., "Regulation of Cre Recombinase Activity by Mutated Estrogen Receptor Ligand-Binding Domains", Biochemical and Biophysical Research Communications, Jul. 7, 1997, 6 pages.
Nguyen et al., "Ligand-binding domains of nuclear receptors facilitate tight control of split CRISPR activity", Nature Communications, Jul. 1, 2016, 10 pages.
Liu et al., "A chemical-inducible CRISPR-Cas9 system for rapid control of genome editing", Nature Chemical Biology, Sep. 12, 2016, 10 pages.
Cho et al., "Targeted genome engineering in human cells with the Cas9 RNA-guided endonuclease," Nature Biotechnology, 31(3): 230-232, 2013.
Cong et al., "Multiplex genome engineering using CRISPR/Cas systems," Science, 339(6121): 819-823, 2013.
Mali et al., "RNA-guided human genome engineering via Cas9," Science, 339(6121): 823-826, 2013.
Guilinger et al., "Fusion of catalytically inactive Cas9 to FokI nuclease improves the specificity of genome modification," Nature Biotechnology, 32(6): 577-582, 2014.
Ran et al., "Double nicking by RNA-guided CRISPR Cas9 for enhanced genome editing specificity," Cell, 154: 1380-1389, 2013.
Shen et al., "Efficient genome modification by CRISPR-Cas9 nickase with minimal off-target effects," Nature Methods, 11(4): 399-402, 2014.
Tsai et al., "Dimeric CRISPR RNA-guided FokI nucleases for highly specific genome editing," Nature Biotechnology 32(6): 569-576, 2014.
Mali et al., "CAS9 transcriptional activators for target specificity screening and paired nickases for cooperative genome engineering," Nature Biotechnology, 31(9): 833-838, 2013.
Fu et al., "Improving CRISPR-Cas nuclease specificity using truncated guide RNAs," Nature Biotechnology, 32(3): 279-284, 2014.
Shen et al., "Conditional knockouts generated by engineered CRISPR-Cas9 endonuclease reveal the roles of coronin in C. elegans neural development," Developmental Cell, 30: 625-636, 2014.
Dow et al., "Inducible in vivo genome editing with CRISPR-Cas9," Nature Biotechnology, 33(4): 390-394, 2015.
Gonzalez et al., "An iCRISPR platform for rapid, rnultiplexable, and inducible genome editing in human pluripotent stern cells," Cell Stem Cell 15(2): 215-226, 2014.
Wang et al., "Genetic screens in human cells using the CRISPR-Cas9 system," Science, 343: 80-84, 2014.
Konermann et al., "Optical control of mammalian endogenous transcription and epigenetic states," Nature, 500: 472-476, 2013.
Polstein et al., "A light-inducible CRISPR-Cas9 system for control of endogenous gene activation," Nature Chemical Biology, 11: 198-200, 2015.
Nihongaki et al., "CR1SPR-Cas9-based photoactivatable transcription system," Chemistry & Biology, 22: 169-174, 2015.
Nihongaki et al., "Photoactivatable CRISPR-Cas9 for optogenetic genome editing," Nature Biotechnology, 33(7): 755-762, 2015.
Zetsche et al., "A split-Cas9 architecture for inducible genome editing and transcription modulation," Nature Biotechnology, 33(2): 139-142, 2015.
Davis et al., "Small molecule-triggered Cas9 protein with improved genome-editing specificity," Nature Chemical Biology, 11(5): 316-318, 2015.
Schellenberger et al., "A recombinant polypeptide extends the in vivo half-life of peptides and proteins in a tunable manner," Nature Biotechnology, 27(12): 1186-1190, 2009.
Kim et al., "Highly efficient RNA-guided genome editing in human cells via delivery of purified Cas9 ribonucleoproteins," Genome Research, 24: 1012-1019, 2014.
Zuris et al., "Cationic lipid-mediated delivery of proteins enables efficient protein-based genome editing in vitro and in vivo," Nature Biotechnology, 33(1): 73-80, 2015.
Wang et al., "Unbiased detection of off-target cleavage by CRISPR-Cas9 and TALENs using integrase-defective lentiviral vectors," Nature Biotechnology, 33(2): 175-178, 2015.
Tsai et al., "GUIDE-seq enables genome-wide profiling of off-target cleavage by CRISPR-Cas nucleases," Nature Biotechnology, 33(2): 187-197, 2015.
Fu et al., "High-frequency off-target mutagenesis induced by CRISPR-Cas nucleases in human cells," Nature Biotechnology, 31(9): 822-826, 2013.
Xu et al., "Vascular development in the retina and inner ear: control by Norrin and Frizzled-4, a high-affinity ligand-receptor pair," Cell, 116: 883-895, 2004.
Coombs et al., "WLS-dependent secretion of WNT3A requires Ser209 acylation and vacuolar acidification," Journal of Cell Science, 123(19): 3357-3367, 2010.
McCulloch et al., "Psammaplin A as a general activator of cell-based signaling assays via HDAC inhibition and studies on some bromotyrosine derivatives," Bioorganic & Medicinal Chemistry, 17(6): 2189-2198, 2009.
Suzuki et al., "REAP: A two minute cell fractionation method," BMC Research Notes, 3: 294, 6 pp., 2010.

\* cited by examiner

FIG. 3
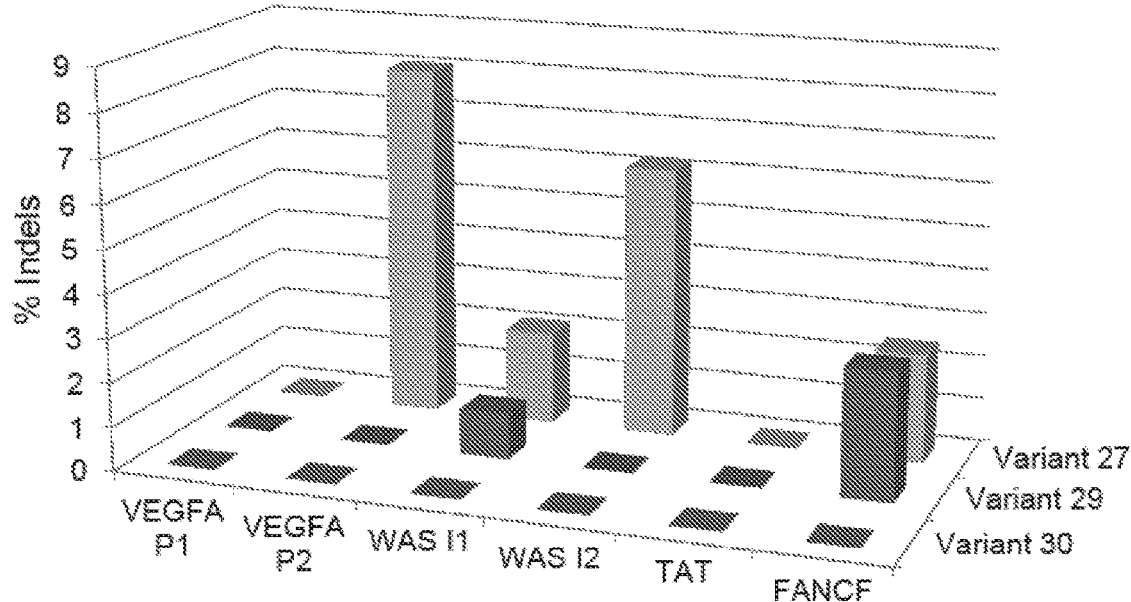
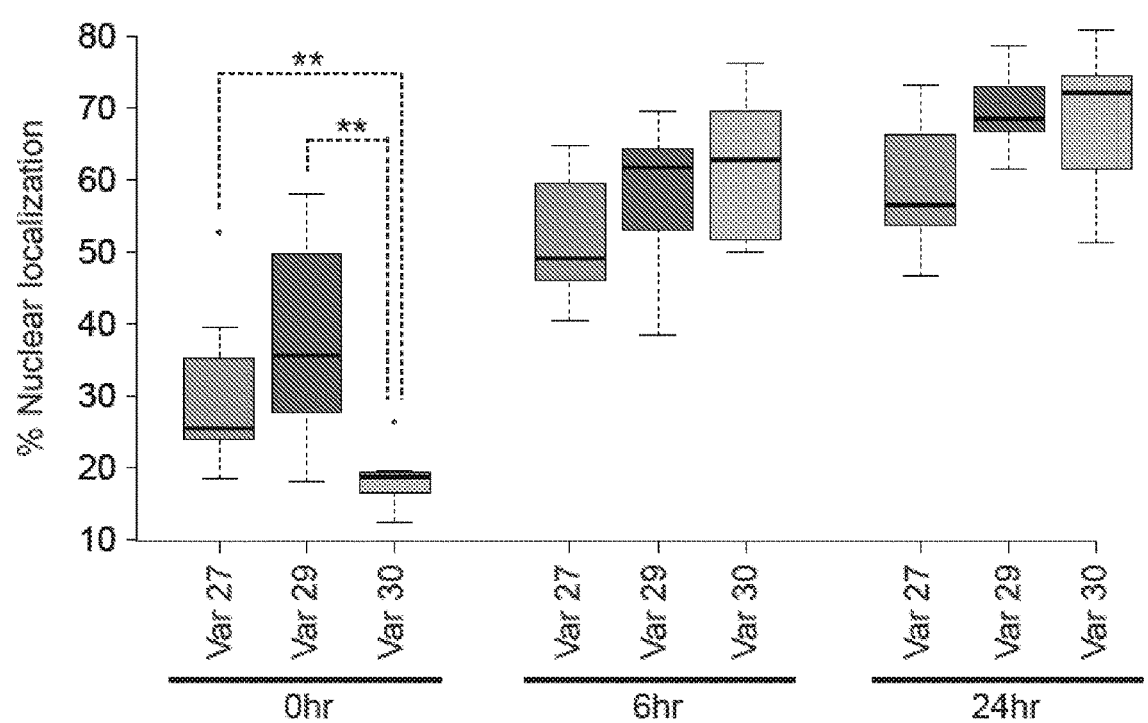

FIG. 3 continued
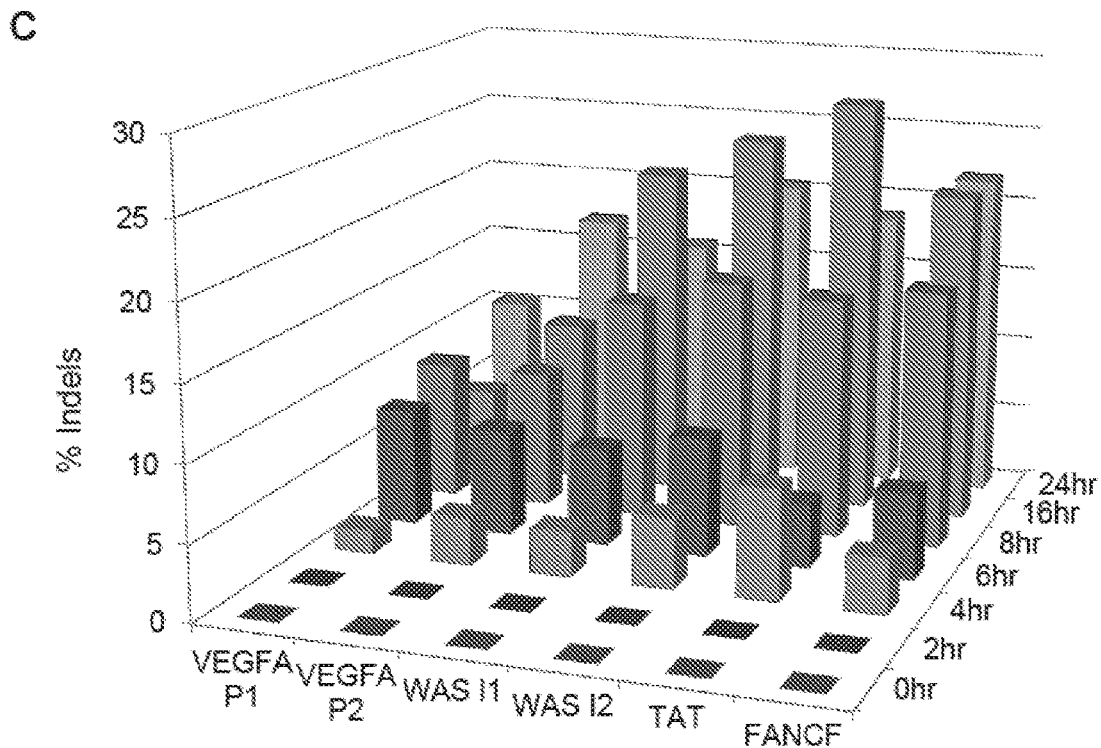
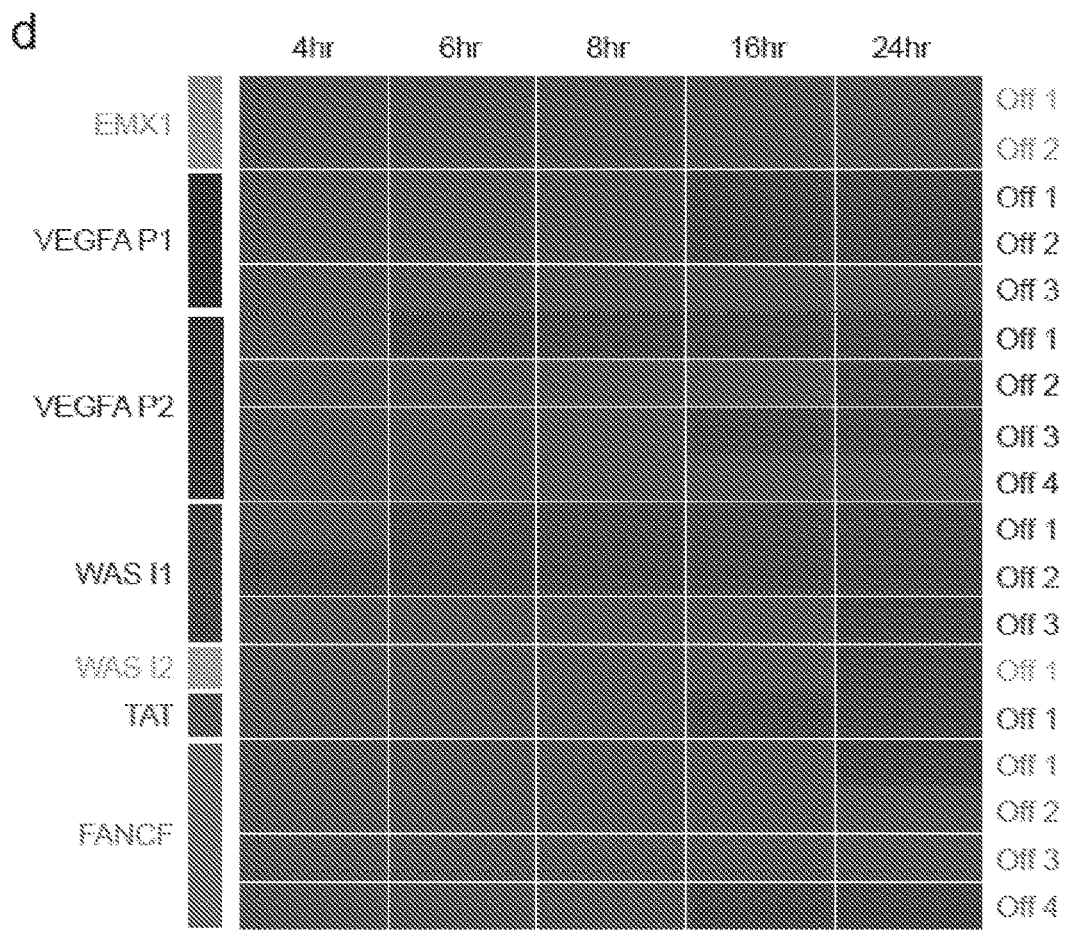

FIG. 4 continued
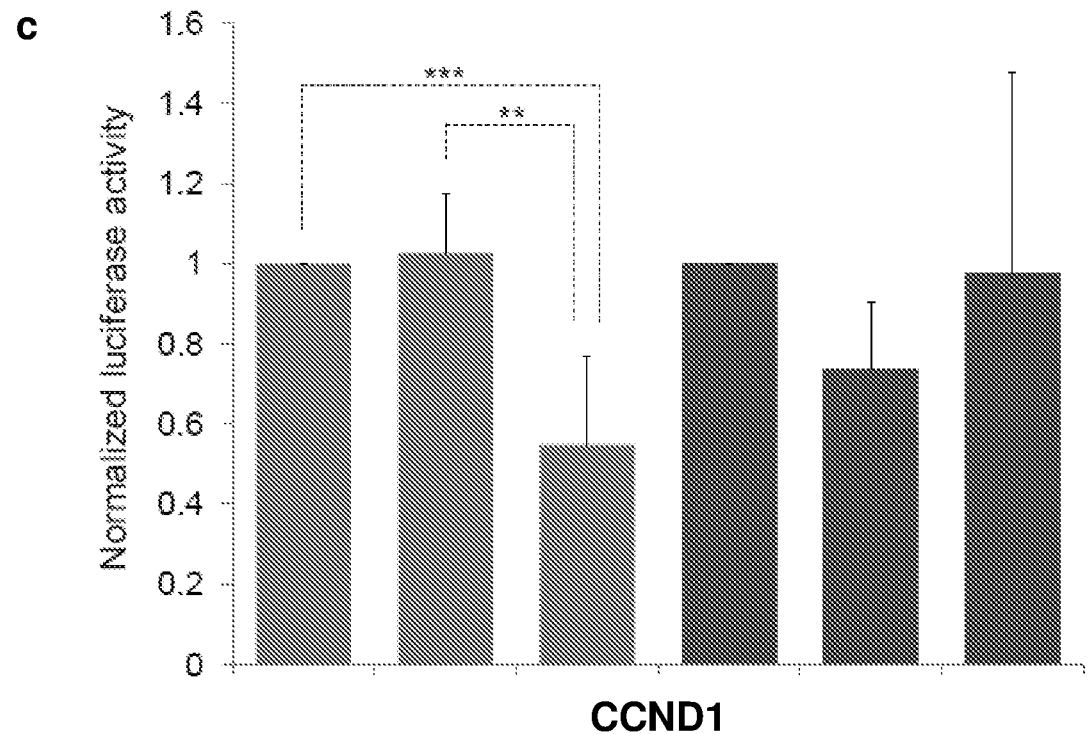
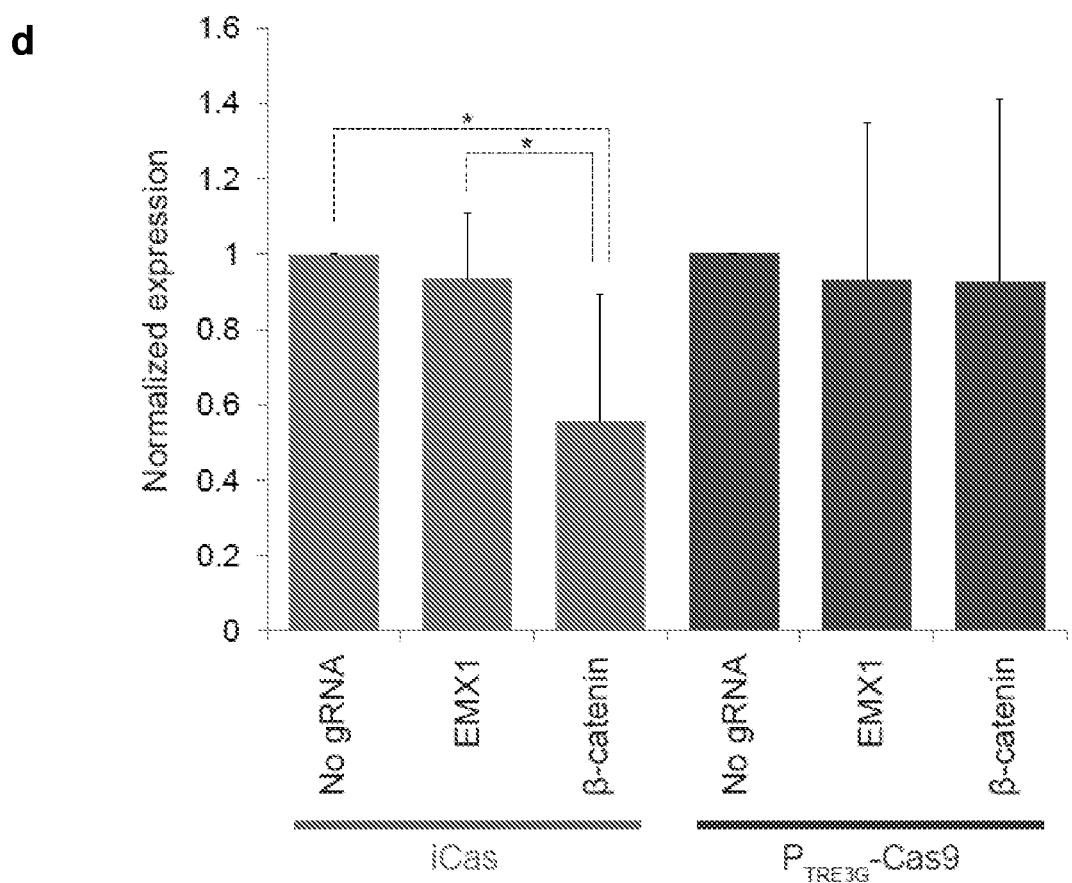

FIG. 5
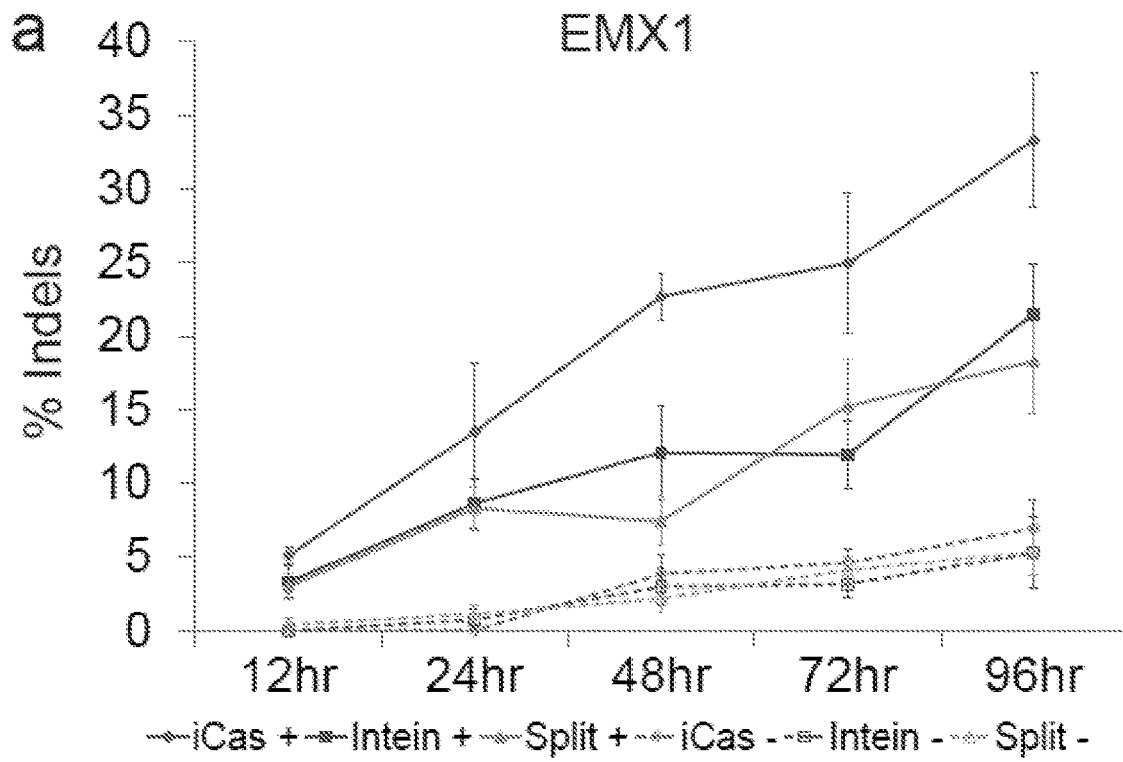
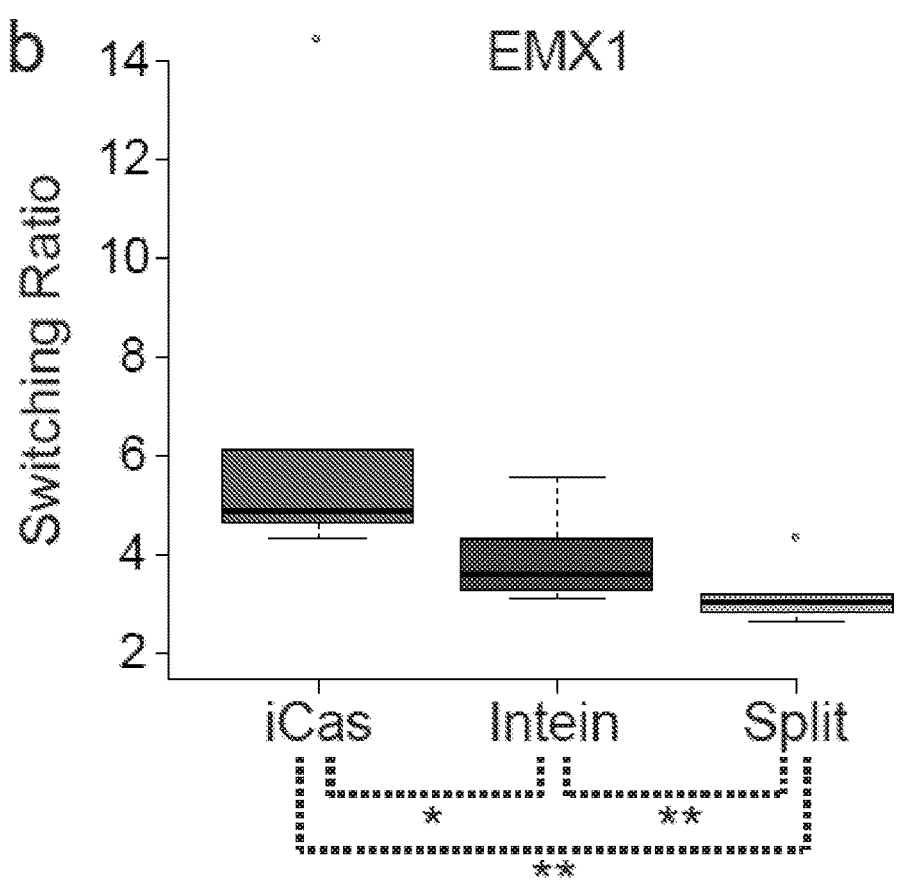

FIG. 9 continued
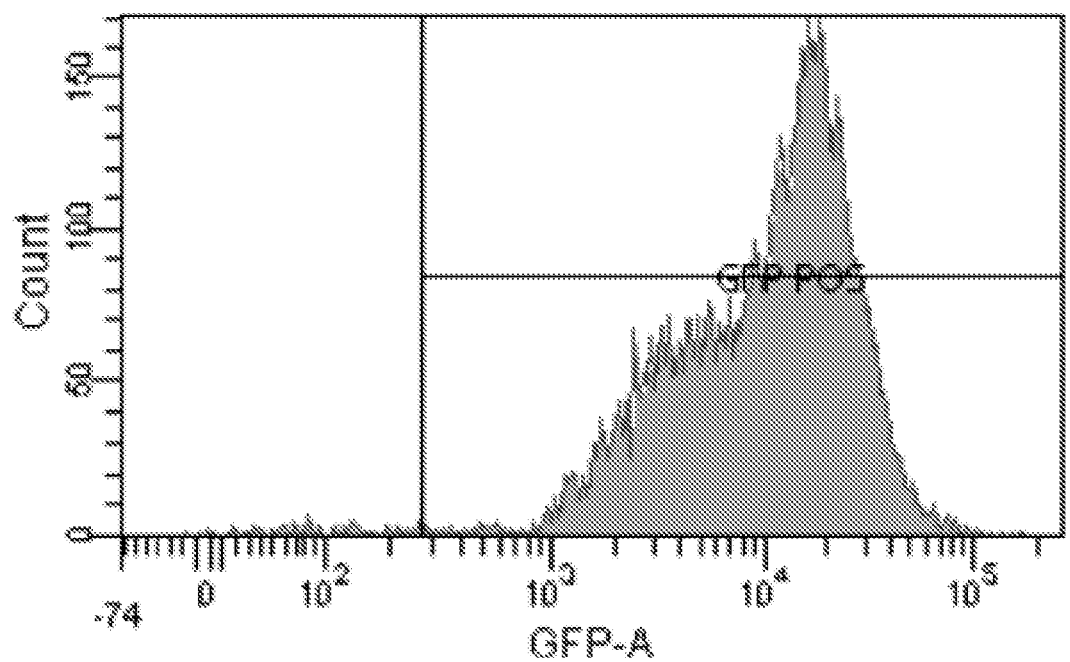
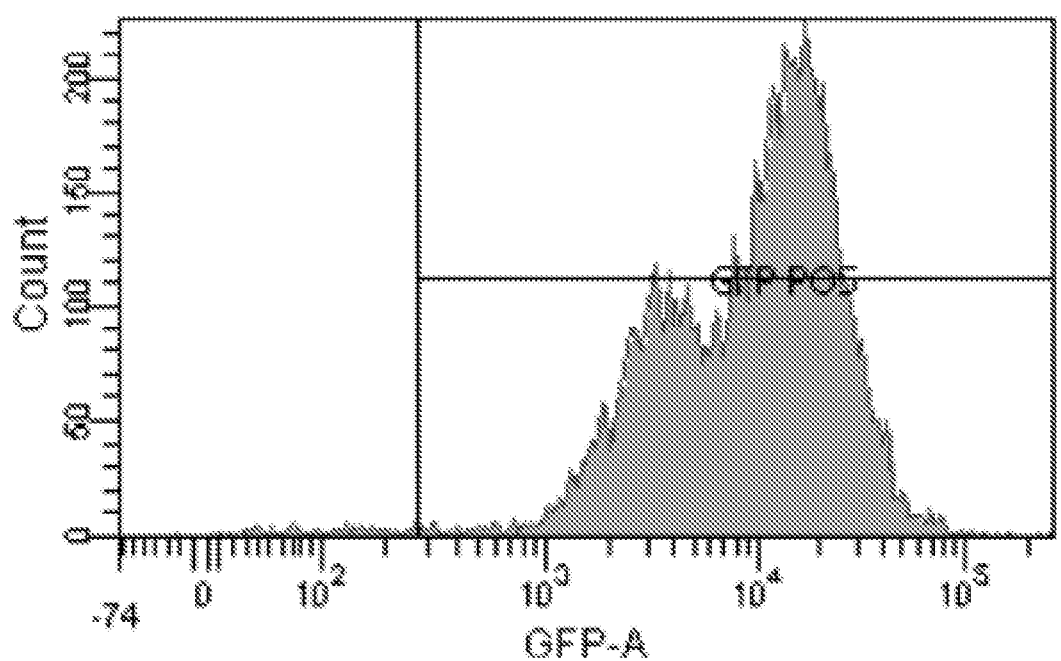

FIG. 10
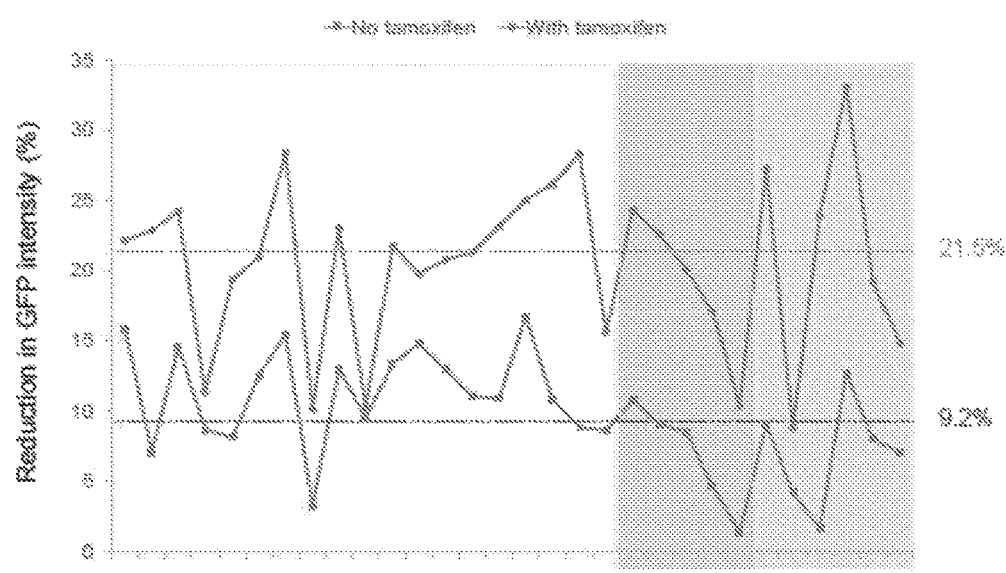
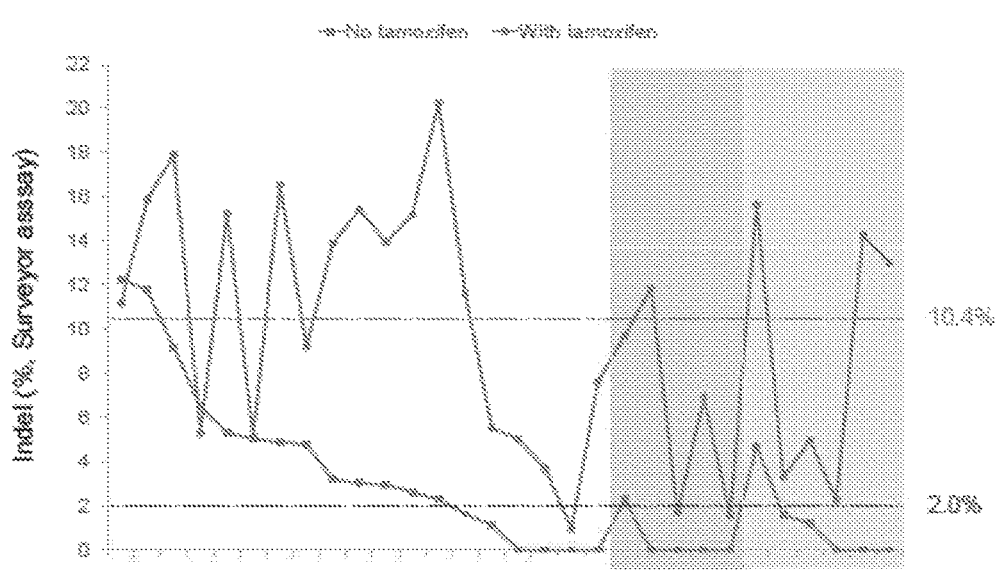

FIG. 14
a
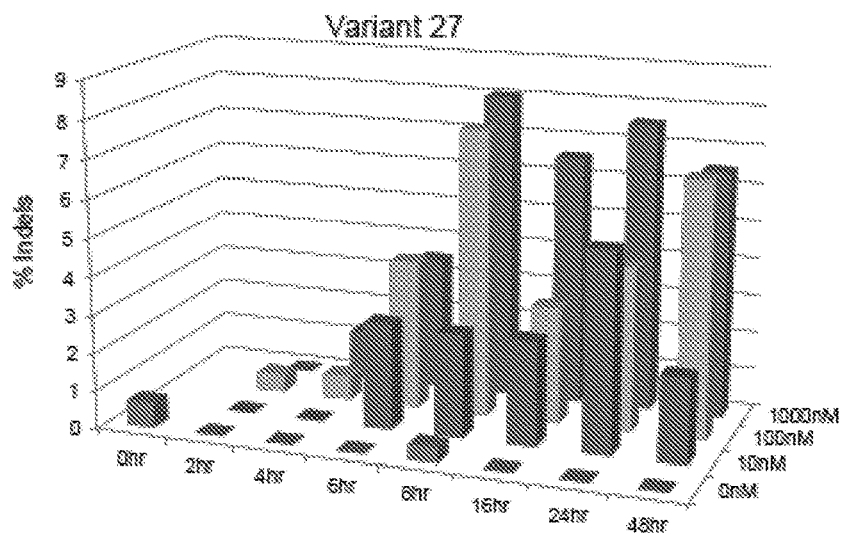
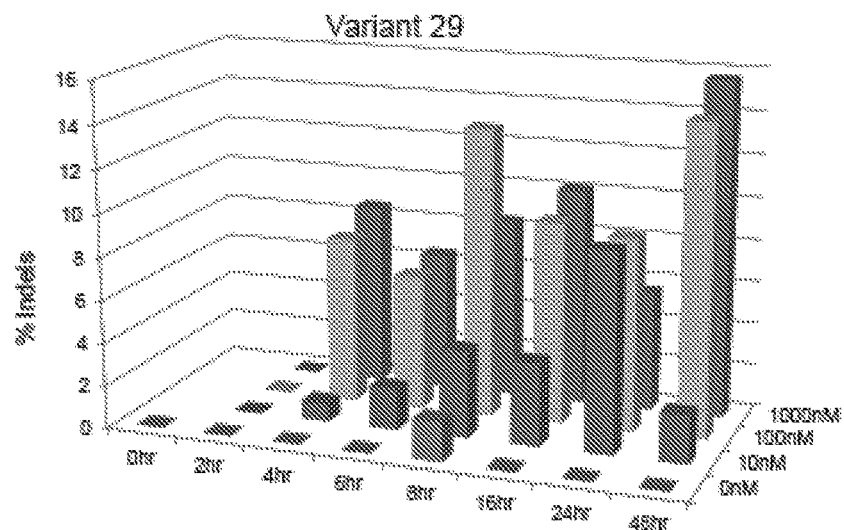
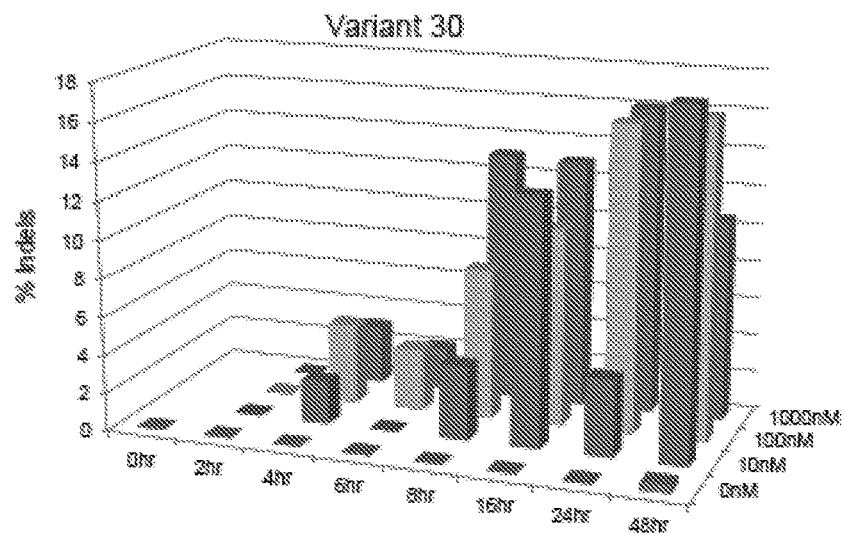

FIG. 14 continued
b
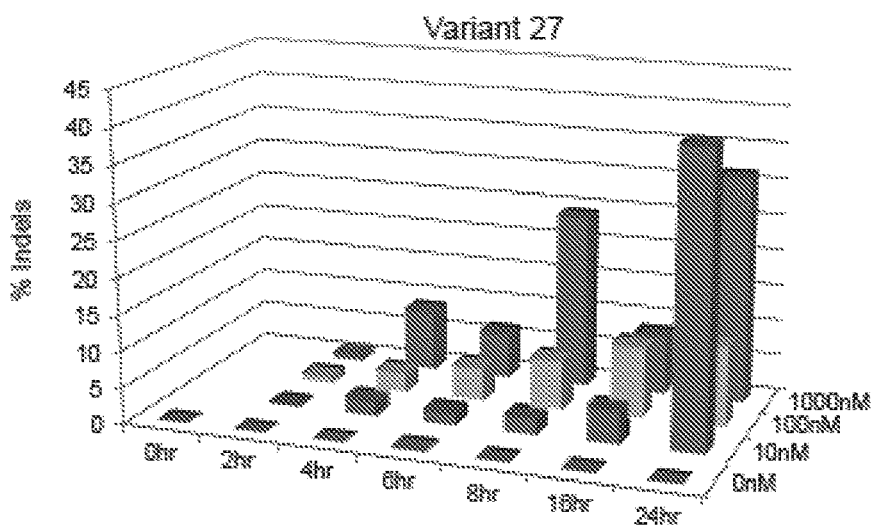
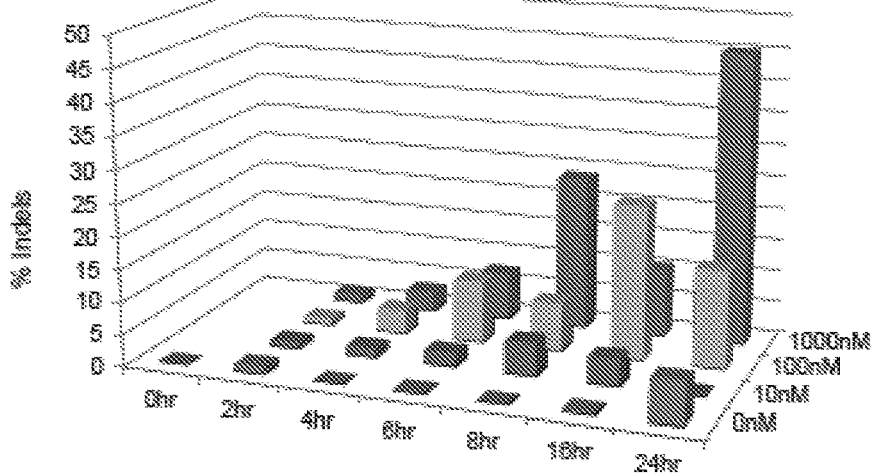
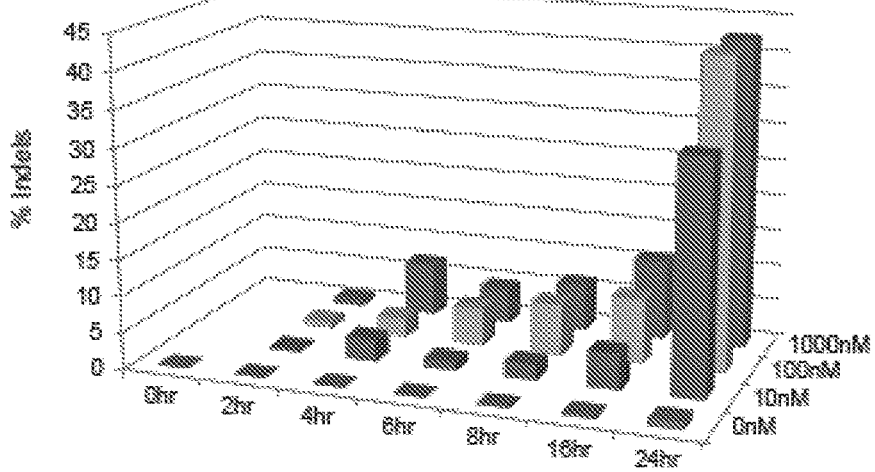

FIG. 15
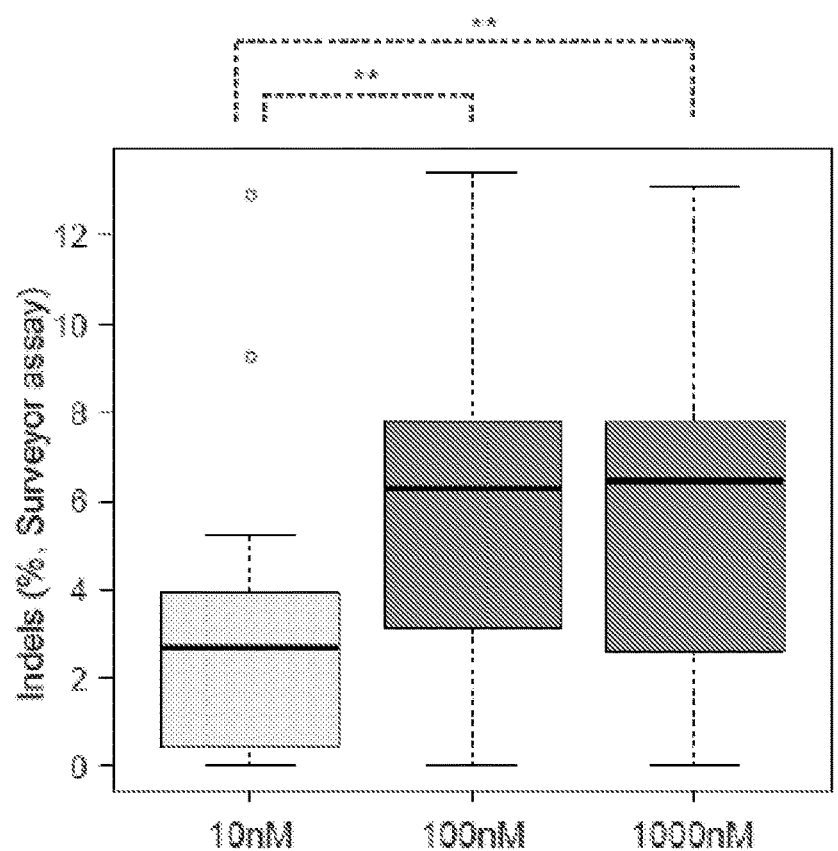
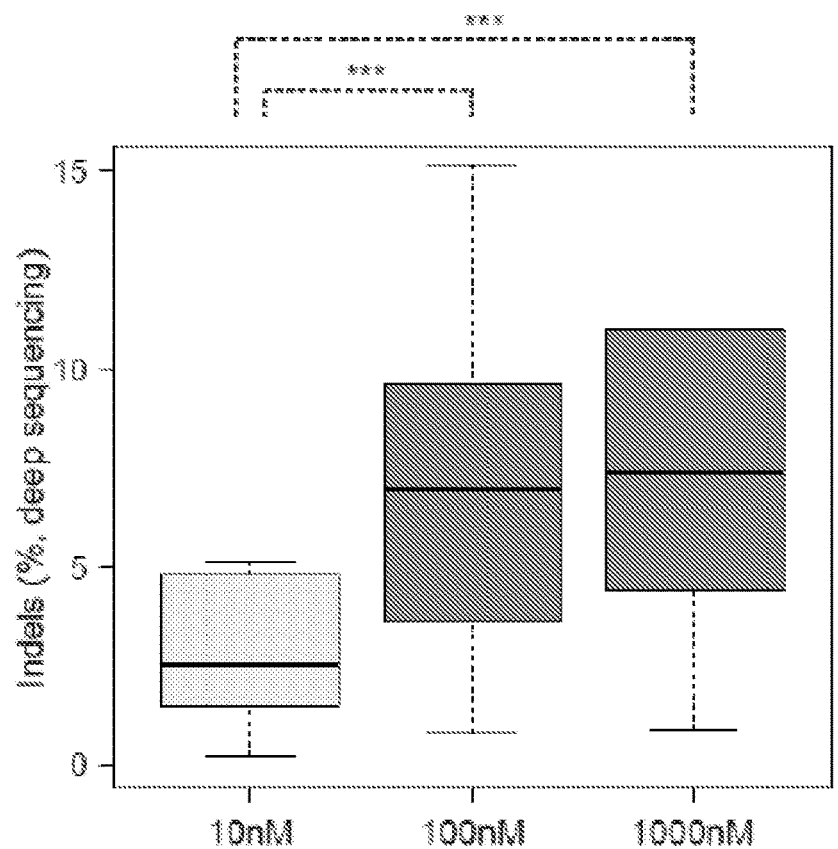

FIG: 16
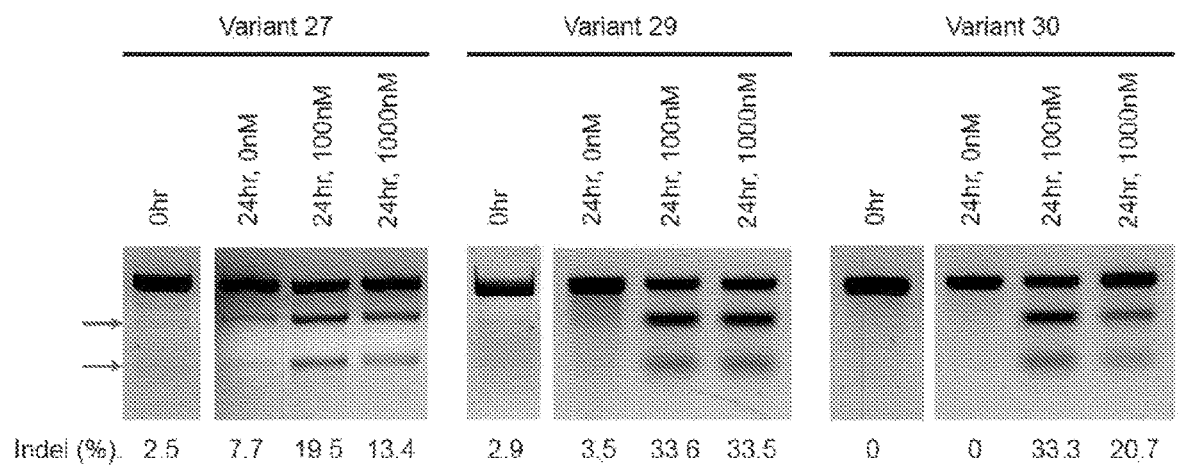
FIG. 17
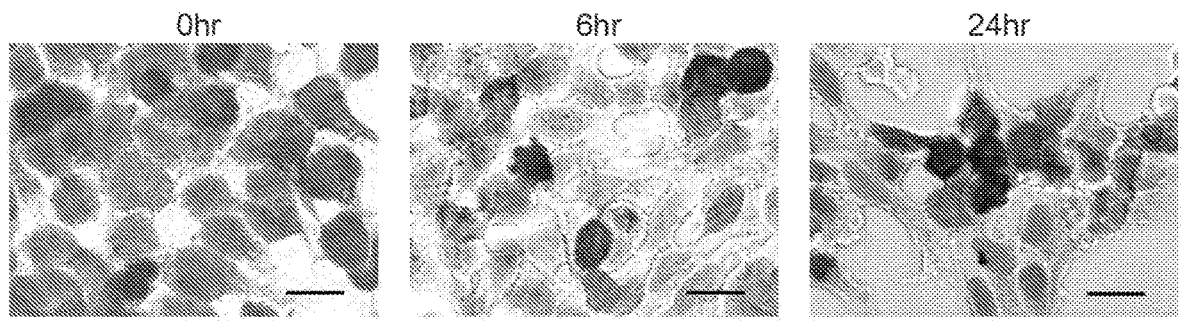
FIG. 18
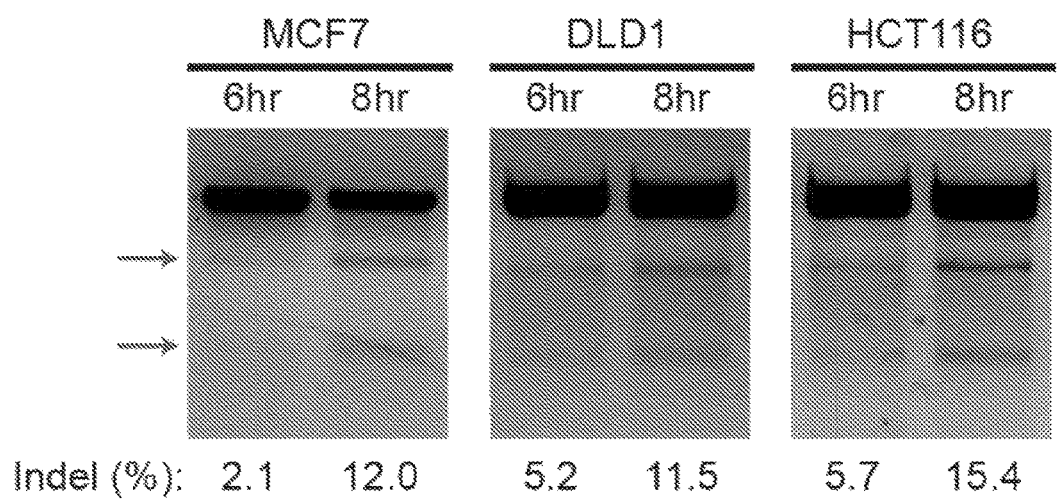

FIG. 19
a
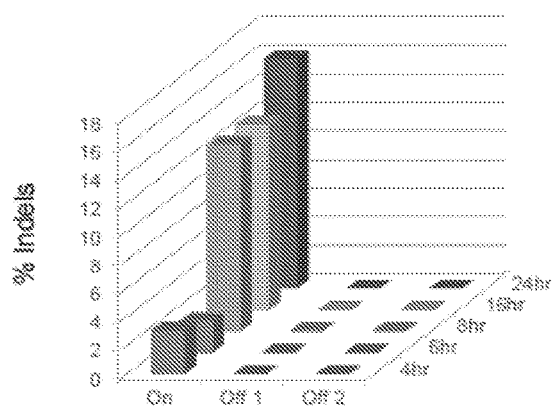
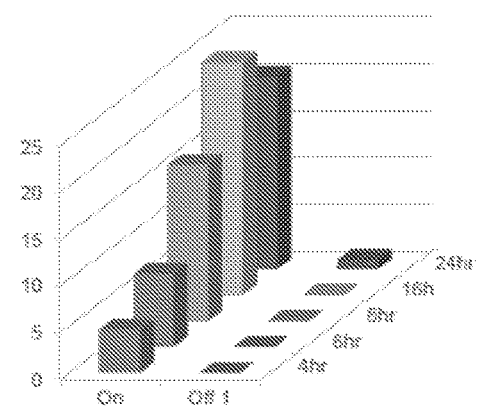
b
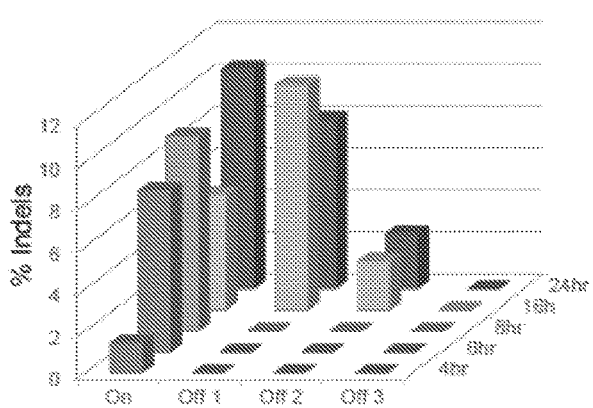
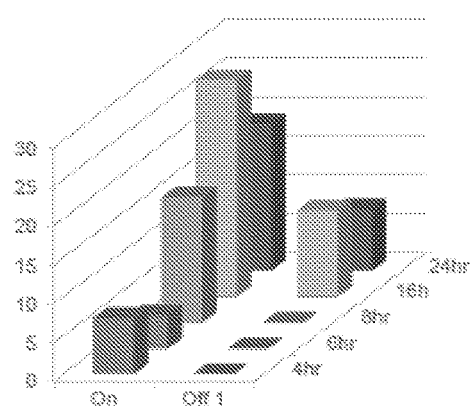
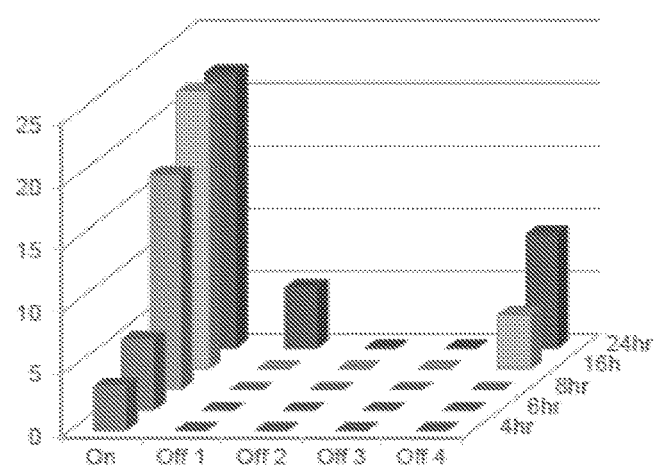

FIG. 26 continued
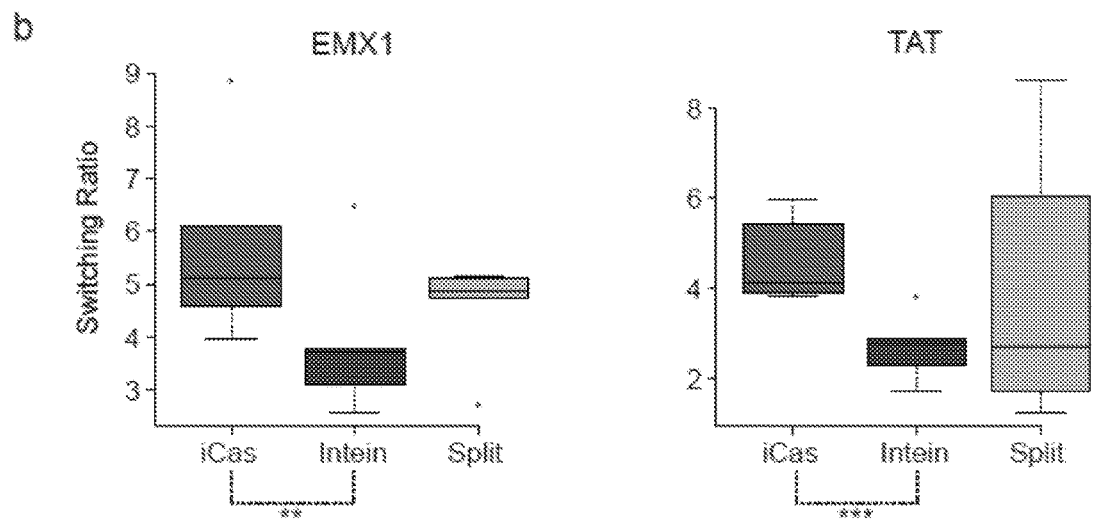
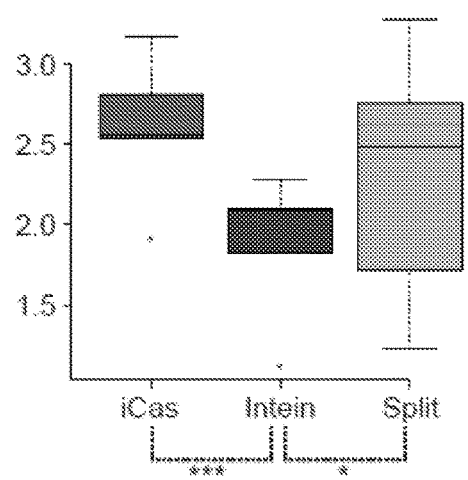
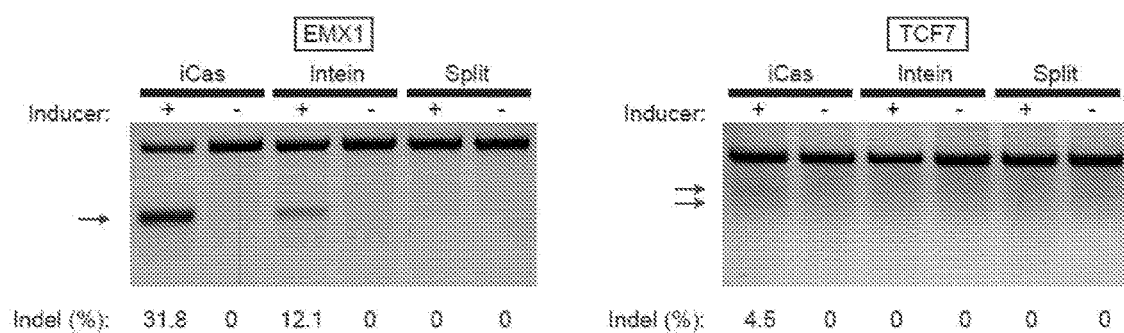

FIG. 27
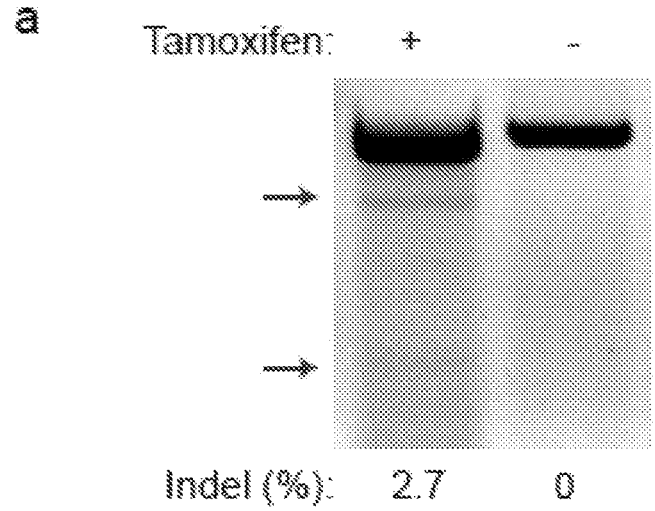
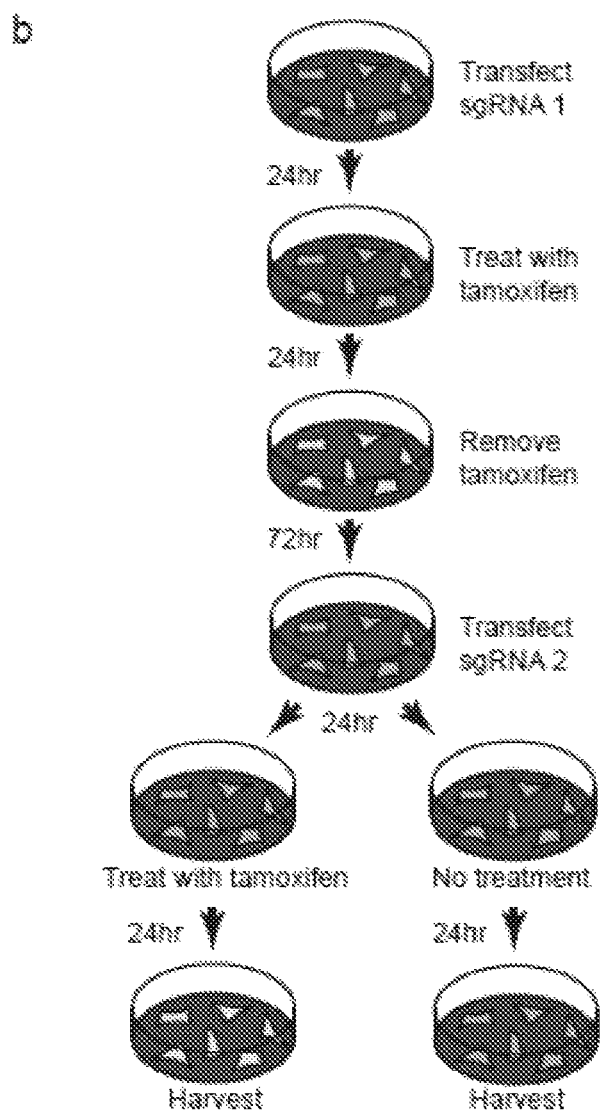

FIG. 31
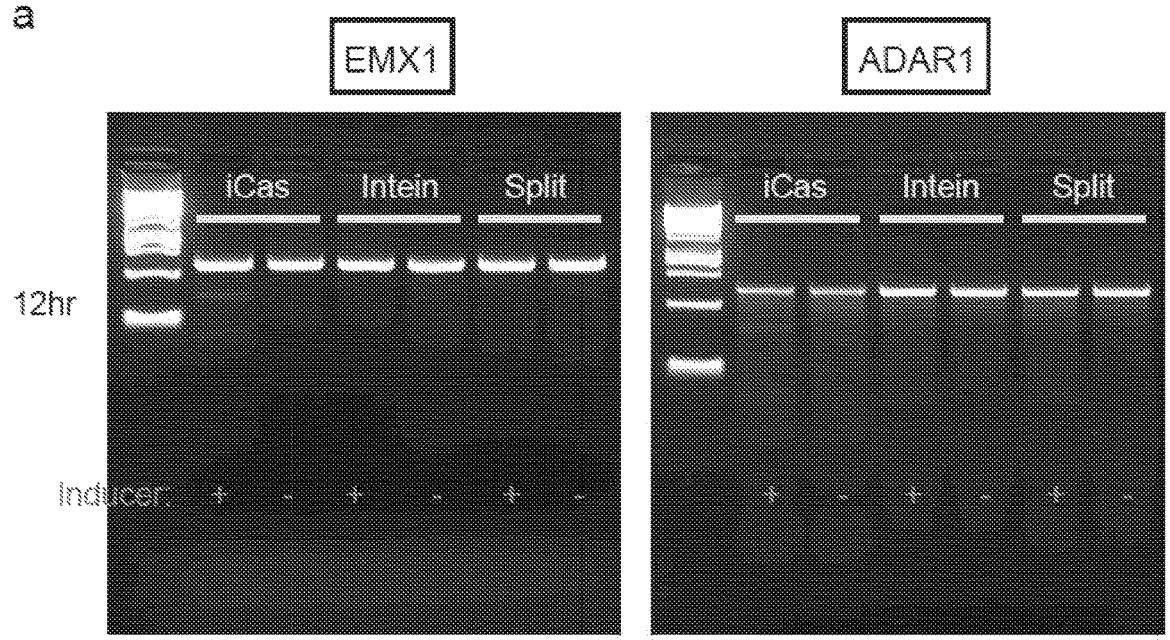
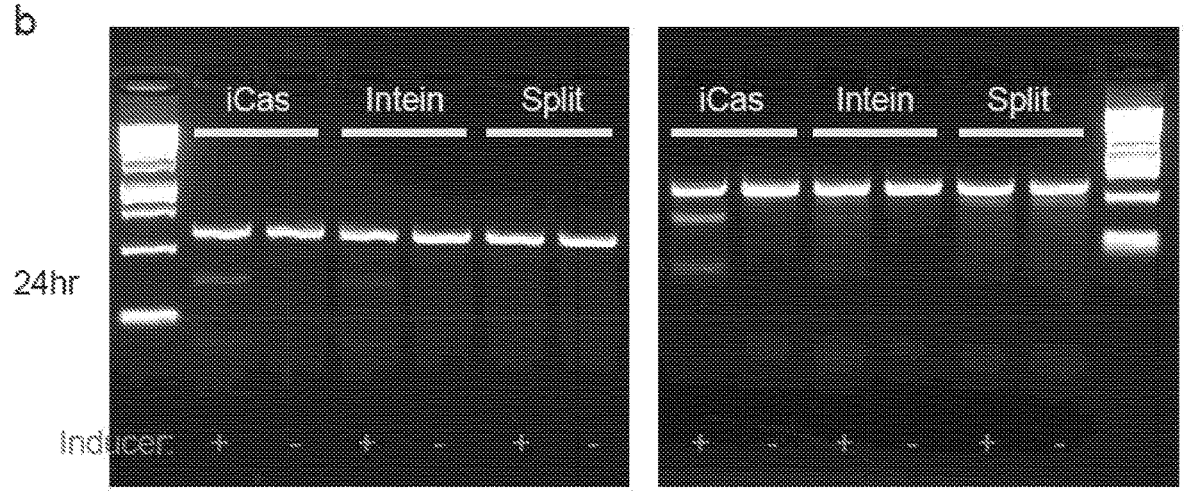

CHEMICAL-INDUCIBLE GENOME ENGINEERING TECHNOLOGY

CROSS-REFERENCE TO RELATED APPLICATIONS

This patent application is a U.S. National Phase application under 35 U.S.C. § 371 of International Application No. PCT/SG2016/050549, filed 7 Nov. 2016, entitled CHEMICAL-INDUCIBLE GENOME ENGINEERING TECHNOLOGY, which claims the benefit of priority of Singapore provisional application No. 10201509153Y, filed 5 Nov. 2015, the contents of which were incorporated by reference in the entirety for all purposes.

INCORPORATION BY REFERENCE

The content of the ASCII text file of the sequence listing named "9869SG4120_Sequence_listing_2630136_1_Revised_2021_04_05_ST25", which is 3,864 kb in size, was created on and electronically submitted via EFS-Web Apr. 9, 2021, is incorporated herein by reference in its entirety.

FIELD OF THE INVENTION

The present invention relates generally to the field of molecular biology. In particular, the present invention relates to genome engineering technology based on CRISPR-Cas9 systems.

BACKGROUND OF THE INVENTION

There are many biomedical and biotechnological applications whereby it is imperative that the activity of enzymes capable of gene editing, for example Cas9, can be switched on and off as desired. For example, the ability to perturb regulatory networks in a particular tissue or at a specific time point is essential for understanding mammalian development. In cell signalling pathways, precise timing is also known to be of paramount importance. One possible approach to create a conditional genome editing system is to place the expression of, for example Cas9, under the control of an inducible promoter or a promoter that is active only in a particular biological context. However, such an approach suffers from several disadvantages. Firstly, the response time is typically slow, as transcription and translation have to occur before any protein activity can be observed. Secondly, the method can be cumbersome to implement in mammalian cells because additional factors (for example, the tetracycline transactivator protein in the case of the doxycycline-inducible promoter) may have to be introduced into the target cells. Thirdly, a context-specific promoter is also not readily generalizable. Fourthly, one of the key issues in the application of CRISPR-Cas9 technology to genome engineering is the specificity of the endonuclease.

An attractive strategy to circumvent the shortcomings of a promoter-based approach is to develop a Cas9 enzyme whose activity can be post-translationally controlled by an external input. Several laboratories have successfully engineered light-inducible systems based on Cas9 or transcription activator-like effectors (TALEs). However, specialized equipment that delivers blue light irradiation is currently uncommon, thereby restricting the adoption of such photo-activatable systems. A split Cas9 architecture was also recently reported, whereby Cas9 was divided into two fragments that can reassemble with the aid of rapamycin-binding dimerization domains to reconstitute the original enzymatic activity. Although this system relies on a simple chemical input, it can be inconvenient to implement due to the need to manipulate multiple Cas9 fragments. Another method depending on the chemical-triggered excision of a function-disrupting intein has been shown to modulate the activity of, for example, Cas9. However, the reported intein-Cas9 is leaky and exhibits some genome editing activity even in the absence of the chemical.

In view of the problems encountered in the art, there is a need for providing a genome engineering/editing system which is capable of being chemically controllable and/or inducible.

SUMMARY

In one aspect, the present invention refers to an endonuclease-based gene editing construct, wherein the construct comprises the following components: a CRISPR-associated endonuclease (such as Cas9 or Cpf1) or a derivative thereof, and at least one or more hormone binding domains of the estrogen receptor (ERT2) or derivatives thereof.

In another aspect, the present invention refers to a nucleic acid sequence encoding the construct as disclosed herein.

In yet another aspect, the present invention refers to a vector comprising the nucleic acid sequence as disclosed herein.

In a further aspect, the present invention refers to a host cell comprising the vector as disclosed herein.

In one aspect, the present invention refers to a kit comprising the construct, as disclosed herein, and tamoxifen, and/or a derivative thereof In another aspect, the present invention refers to a method of editing a genome of a host cell using the construct of any one of the preceding claims, the method comprising transfecting, nucleofecting, or electroporating the host cell with the nucleic acid sequence as disclosed herein; and incubating the cell of step (a) with an inducing agent.

In yet another aspect, the present invention refers to a method of editing a genome of a host cell using the construct of any one of the preceding claims, wherein the host cell comprising the nucleic acid sequence as disclosed herein is incubated with an inducing agent.

BRIEF DESCRIPTION OF THE DRAWINGS

The invention will be better understood with reference to the detailed description when considered in conjunction with the non-limiting examples and the accompanying drawings, in which:

FIG. 3|Optimization of 4-HT treatment conditions. (a) Background activity of Cas9 variants 27, 29, and 30 at multiple genomic loci (P1 and P2, promoter sites; I1 and I2, intron sites), as determined by Surveyor assay to quantify INDEL frequency (n=1 replicate for variants 27 and 29; n=2 (VEGFA P1 and P2) or 3 (WAS I1 and I2, TAT, and FANCF) biological replicates for variant 30). (b) Intracellular localization of the Cas9 variants as determined by immunohistochemistry. Transfected HEK293 cells were untreated (0 h) or treated with 4-HT for 6 or 24 h before they were fixed and stained (n=7 biological replicates per construct and time point). At least 300 cells were counted for each sample. Although 4-HT treatment led to an increase in the percentage of cells containing nuclear protein for all three Cas9 constructs, variant 30 showed the lowest percentage of cells with nuclear Cas9 in the absence of 4-HT (**$P<0.05$, Wilcoxon rank-sum test); var, variant. Center lines, median; box limits, interquartile range; whiskers, 1.5× interquartile range. (c) Targeting efficiency of iCas (variant 30) across multiple genomic loci. Cells were analyzed by Surveyor assay after different durations of treatment with 1 μM 4-HT, applied 24 h after transfection (n≥2 biological replicates for each locus and time point; see Online Methods for details). (d) DNA-modification specificity of iCas with different durations of 4-HT treatment, analyzed by Surveyor assay for off-target modifications (off) at various loci. Blue indicates no cleavage observed; red indicates the presence of cleavage bands (see Table 2 for details)

Specifically, to estimate the INDEL frequency, PCR amplicons were cloned into the pUC19 vector and sequenced at least 24 clones for each sample. Consistent with the results from Surveyor assays and deep sequencing, an increase in genome modification was observed upon addition of 4HT for each of the genomic locus tested. However, it was noted that even in the absence of the chemical, variant E exhibited some leaky genome editing activity, indicating that the construct needed to be further optimized in order to reduce the background activity of the fusion protein.

Figure 8:
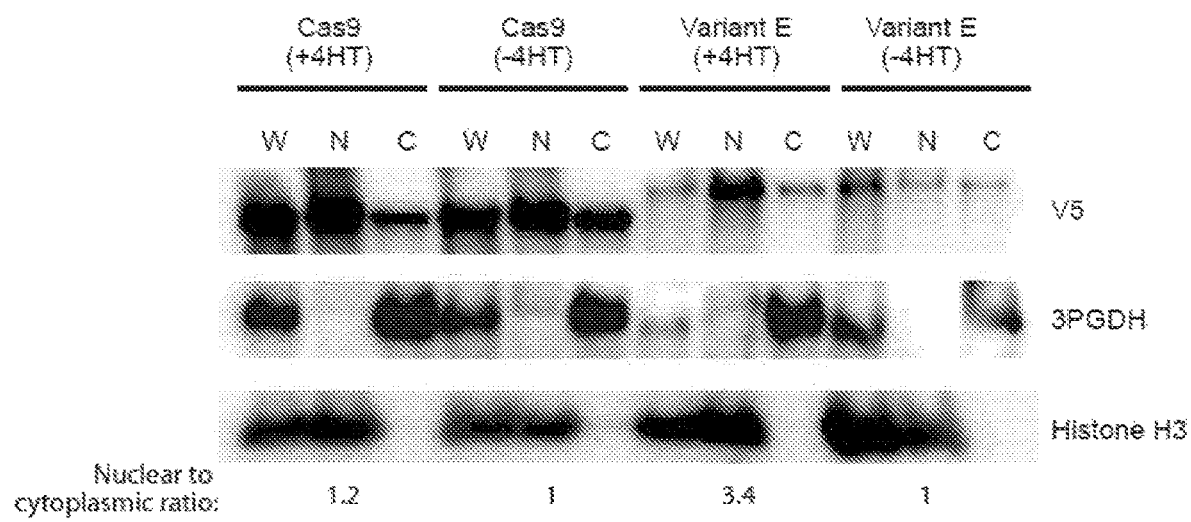

FIG. 8|Subcellular localization of an ERT2-Cas9-ERT2 fusion. Western blot analysis was performed to determine the subcellular distribution of both wildtype Cas9 and the Cas9 variant E (see FIG. 1b) in the presence or absence of 1 µM 4HT. Transfected HEK293 cells were separated into cytoplasmic and nuclear fractions using the REAP protocol1. Both the wildtype Cas9 protein and variant E were tagged with a V5 epitope and thus could be readily detected using an α-V5 antibody. 3PGDH served as a cytosolic marker, while total histone H3 served as a nuclear marker. Treatment with 1 µM 4HT for 24 hours caused a 3.4-fold increase in the nuclear-to-cytoplasmic ratio of the ERT2-Cas9-ERT2 protein but only a 1.2-fold increase for the wildtype Cas9 protein. W: whole cell lysate, N: nuclear fraction, C: cytoplasmic fraction.

Figure 9:
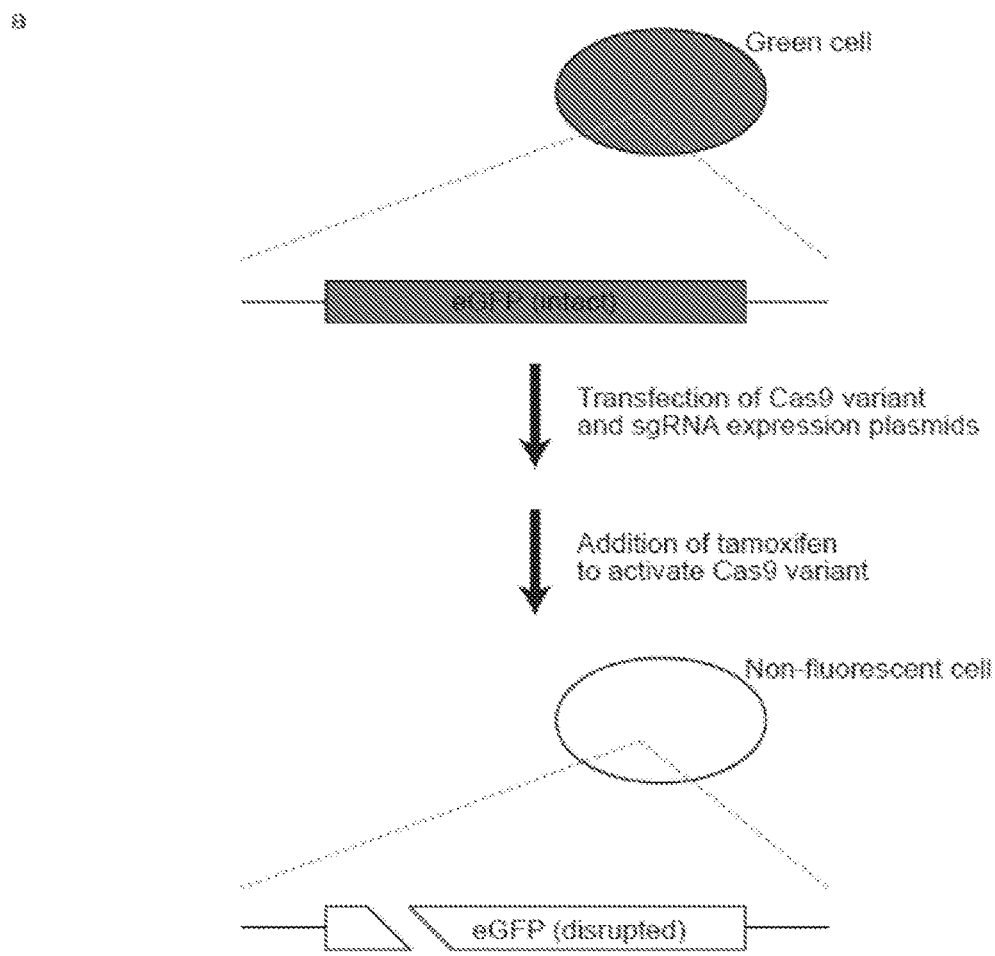

FIG. 9|GFP disruption assay for evaluating different fusion proteins of Cas9 and ERT2. (a) shows a schematic illustrating the principle behind the GFP disruption assay. Fluorescent cells are transfected with a plasmid encoding a Cas9 variant and a sgRNA targeting the eGFP gene. Upon addition of 4HT, the Cas9 variant translocates into the nucleus and cleaves the targeted genomic locus, thereby stimulating the error-prone, non-homologous end-joining (NHEJ) pathway for DNA repair. If a frame shift mutation occurs, the cell will show a loss of fluorescence signal. (b) shows flow cytometry graphs depicting representative data from a multitude of flow cytometry experiments. Within the HEK293-GFP cells, there are two sub-populations, namely GFP-high and GFP-intermediate cells. When the HEK293-GFP cells are transfected with an eGFP-targeting sgRNA and an active Cas9 enzyme, they lose fluorescence, as shown by an increase in the proportion of cells that are GFP-intermediate. Hence, to determine the activity of a Cas9 variant in the presence or absence of 4HT, mean GFP fluorescence intensity was measured from at least 10,000 live single successfully transfected (OFP-positive) cells for every sample.

Figure 10:
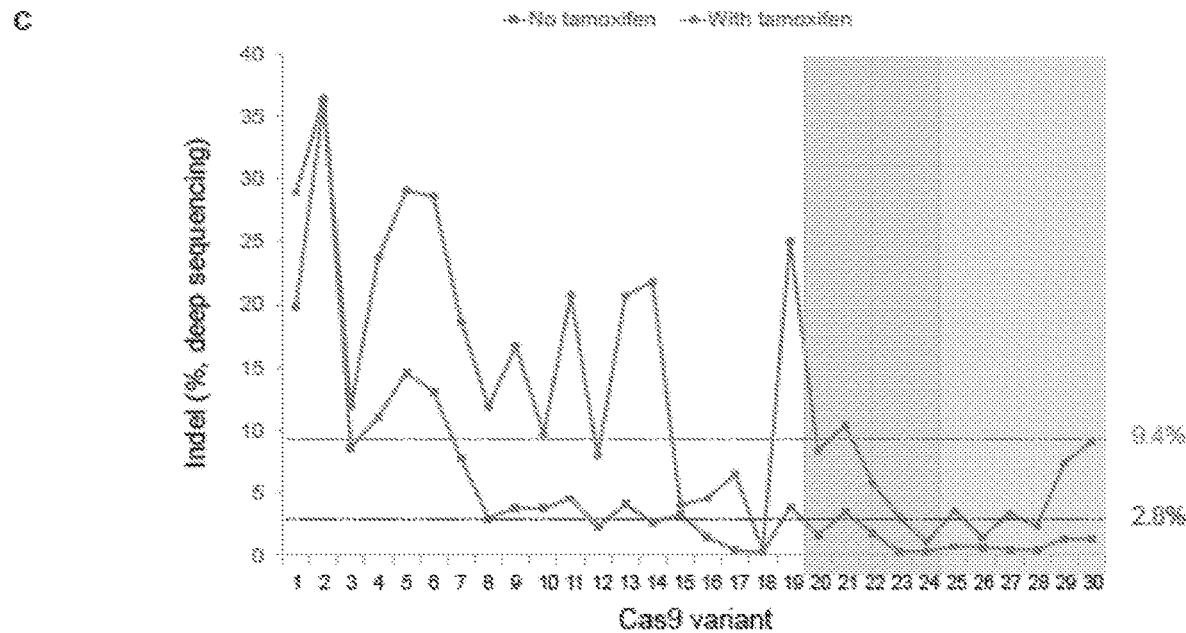

FIG. 10|Individual results from the evaluation of 30 different fusions of Cas9 and ERT2. (a) shows line graphs depicting results of the GFP disruption assay. Light yellow background shading indicates variants with two copies of ERT2 each, light blue shading indicates variants with three copies of ERT2 each, and light red shading indicates variants with four copies of ERT2 each. The dotted horizontal lines depict the median reductions in GFP intensity. Every construct was tested in at least six biological replicates. In the absence of the inducer, most of the Cas9 variants with three or four ERT2 domains exhibit a lower reduction in GFP signal than the median (9.2%). (b) shows line graphs depicting results of the Surveyor cleavage assay. Within each colour background shading, the variants are ranked in decreasing order of INDEL frequency observed without 4HT. The blue dotted horizontal line represents the median INDEL frequency observed in the absence of the inducer (2.0%), while the orange dotted horizontal line represents the median INDEL frequency observed in the presence of the inducer (10.4%) (n=2 biological replicates per construct). Most of the Cas9 variants with three or four ERT2 domains exhibit lower background activity (no 4HT present) than the median. (c) shows line graphs depicting the results of deep sequencing experiments. The orange or blue dotted horizontal line indicates the median INDEL frequency measured with or without 4HT respectively (n=2 biological replicates per construct). Notably, all the Cas9 variants with four copies of ERT2 displayed lower levels of leaky background activity than the median (2.8%).

Figure 11:
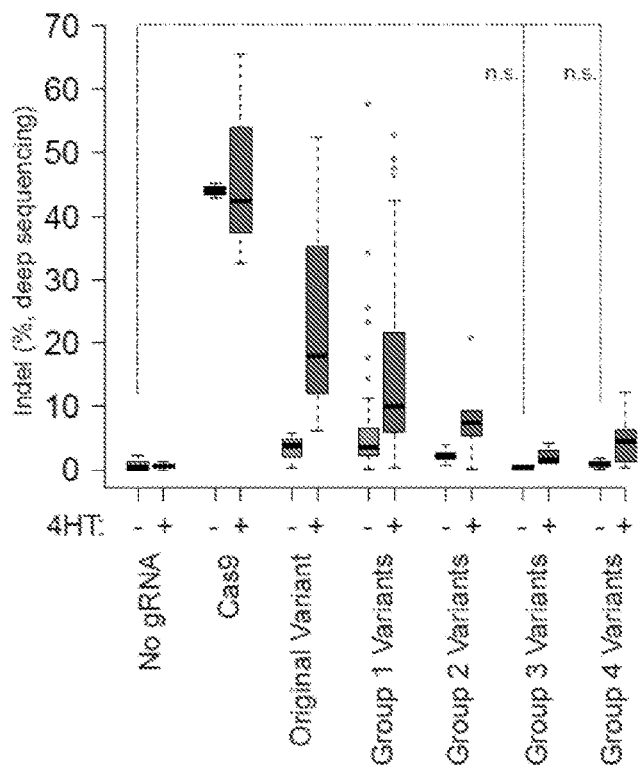

FIG. 11|Assessing the effectiveness of different optimization strategies. Data is shown as box plots, depicting the performance of four classes of Cas9 variants (see FIG. 2a), which was evaluated by Illumina deep sequencing. INDEL frequency was quantified from high throughput sequencing of DNA amplified from the EMX1 target locus in the absence or presence of 4HT (n=2 biological replicates per construct). A no-guide RNA control was included to determine the background measurement error. Without 4HT, Group 3 and 4 variants exhibited an activity level that is not above background (n.s.: not significant, P>0.25, Wilcoxon rank sum test).

Figure 12:
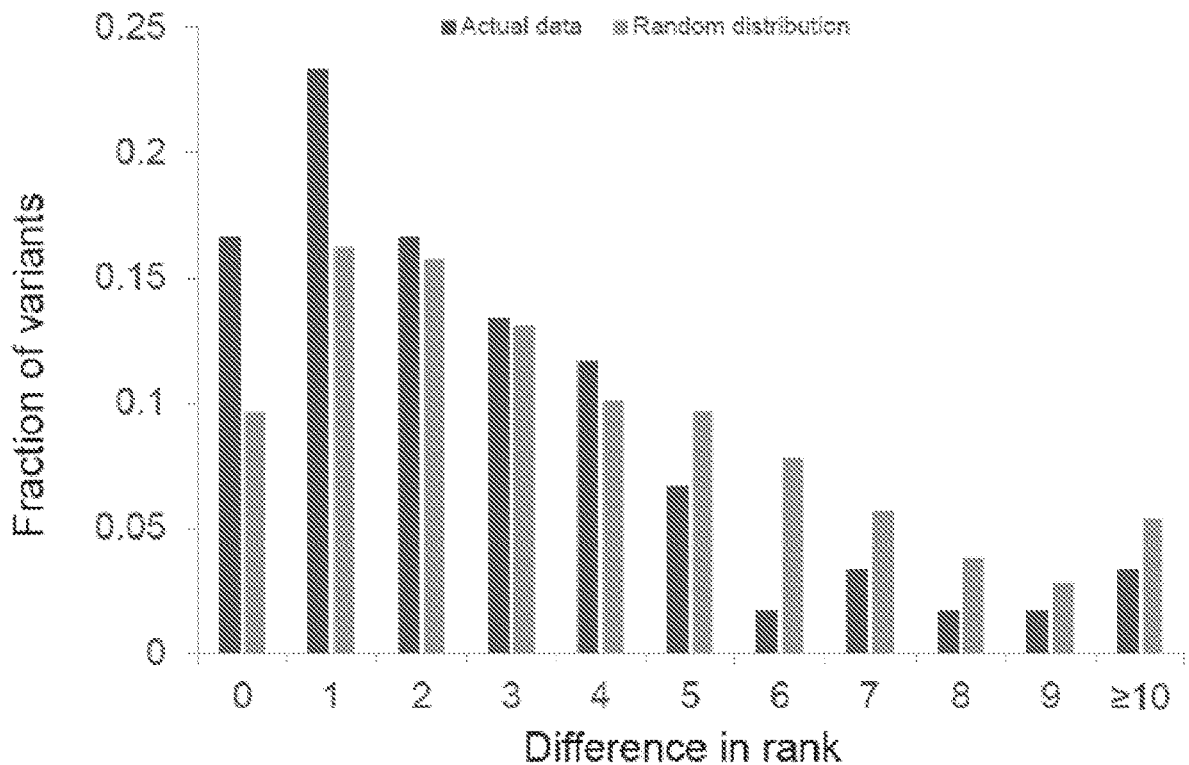

FIG. 12|Comparison of results from GFP disruption assay, Surveyor cleavage assay, and deep sequencing. To determine how well the results from the different assays agree with one another, the performance of the 30 tested Cas9 variants was rank ordered in terms of leakiness and level of induced activity for each of the three assays. The difference in rank between any two assays for every Cas9 variant was then calculated and the data shown as column graphs. Notably, it was found that the distribution of rank differences is clearly non-random (P<0.05, Kolmogorov-Smirnov test) and that for most of the Cas9 variants, the relative rankings from at least two of the assays are in close agreement with one another.

Figure 13:
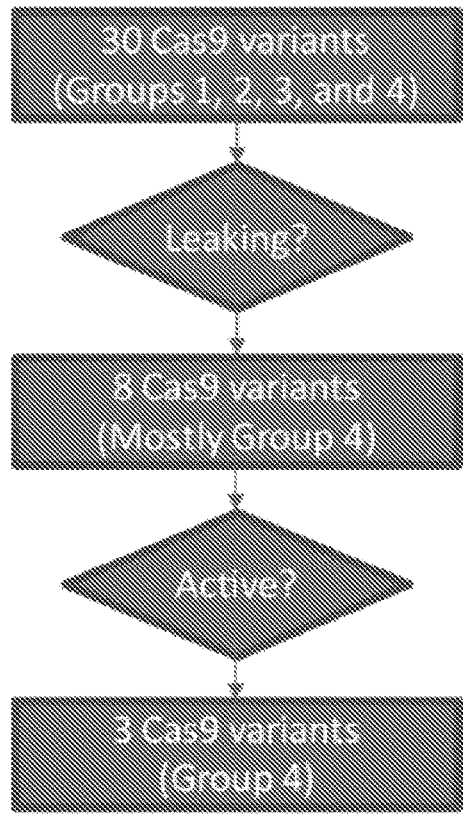

FIG. 13|Flowchart for identifying the best-performing Cas9 variants. A total of 30 Cas9 variants, divided into four groups based on their architecture (see FIG. 2a), were evaluated for leakiness in activity and cutting efficiency. The different fusion proteins were assessed using the GFP disruption assay, Surveyor assay, and deep sequencing. Only eight of the variants showed less background editing activity than the original ERT2-Cas9-ERT2 protein (variant E) across all experiments. Out of these, three variants, all of which contained four copies of ERT2, showed a clear increase in editing activity upon the addition of 4HT to a level that is above the leakiness of variant E in all experiments.

FIG. 14|Effect of 4HT dose on EMX1 targeting efficiency, as shown in three-dimensional column graphs. (a) The extent of genome modification was quantified using the Surveyor cleavage assay. Various concentrations of 4HT over different treatment durations were tested for each of the top three best-performing Cas9 variants (n=2 or 3 biological replicates for each data point, except for Variant 27's 16 hr and 48 hr time points where n=1 replicate). Editing activity appeared to show a general increase with longer durations of 4HT treatment for all three variants. (b) The extent of genome modification was quantified using Illumina deep sequencing. Due to the high sensitivity of sequencing, INDELs could be detected within 2 hours of 4HT treatment for all the three variants. Additionally, the extent of genome modification increased with longer periods of chemical treatment, agreeing with the results from the Surveyor assays (n=1 replicate for the 0 hour, 16 hour, and 24 hour time points; n=2 or 3 replicates for the 2 hour, 4 hour, 6 hour, and 8 hour time points).

FIG. 15|Titration of 4HT concentration for optimal induction of genome editing activity. The extent of genome modification at the EMX1 locus was measured using (a) the Surveyor assay and (b) deep sequencing for three different concentrations of 4HT. Overall, treatment with 10 nM 4HT consistently resulted in lower INDEL frequencies than either 100 nM or 1000 nM 4HT ( $P<0.005$, * $P<0.001$, Wilcoxon rank sum test), indicating that at least 100 nM 4HT should be used for maximum activation of the inducible genome editing system.

FIG. 16|Genome modification at the FANCF locus in HEK293 cells, the data represented as images showing the results and the concentration of gene induction. 24 hours after transfection with Cas9 variant 27, 29, or 30, the cells were either harvested immediately (0 hour time point) or were exposed to 0 nM, 100 nM or 1000 nM 4HT for another 24 hours before genomic DNA was isolated and analysed by the Surveyor assay. Arrows indicate the expected cleavage bands. Regardless of the Cas9 variant used, strong cleavage bands were observed when the cells were treated with 100 nM or 1000 nM 4HT. However, in the absence of 4HT, no cleavage band was detected for variant 30, while cuts were observed for variants 27 and 29. Furthermore, the leakiness in editing activity became more pronounced over time, as indicated by the increase in INDEL frequency from 2.5% to 7.7% for variant 27 and from 2.9% to 3.5% for variant 29.

FIG. 17|Intracellular localization of the Cas9 variants. Micrographs of representative images are shown. Immunohistochemical staining was utilised to determine the localization of the (ERT2)2-Cas9-(ERT2)2 proteins. 24 hours after transfection, the HEK293 cells were treated with 4HT for 0 hour, 6 hours, or 24 hours before fixing and staining them with anti-V5 antibody. Only the cells that were successfully stained (dark cells) were counted (scale bar=10 m). Over 300 cells were counted for each sample and time point.

FIG. 18|Genome modification at the TAT locus in different cancer cell lines. The efficiency of iCas was tested in the breast cancer cell line MCF7, as well as in the colorectal cancer cell lines DLD1 and HCT116, the results of which are shown as gel images. Based on the Surveyor assays, genome modifications were detected after the cells were treated with 1 µM 4HT for 6 hours. The INDEL frequency increased when the treatment duration was lengthened to 8 hours for all the cell lines tested. Arrows indicate the expected cleavage bands.

Figure 19:
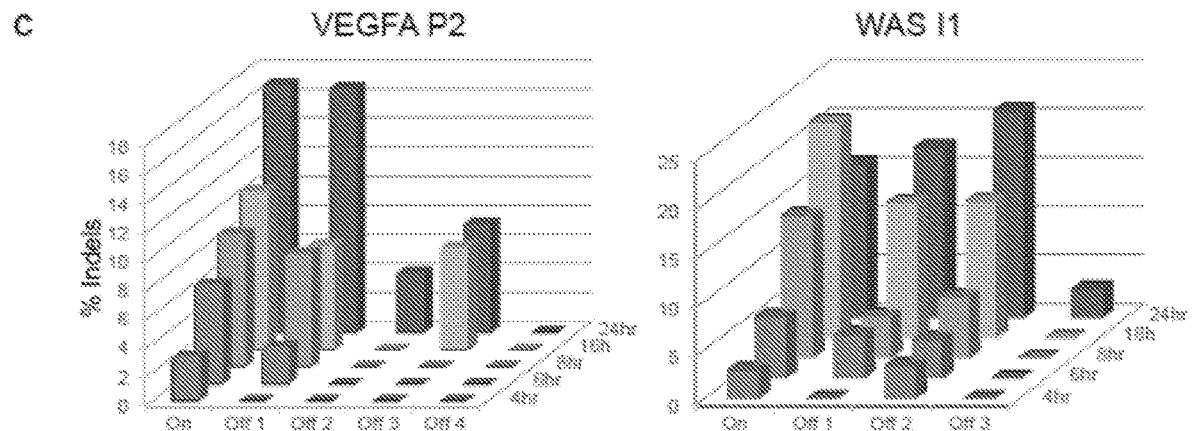

FIG. 19|Specificity of iCas evaluated by Surveyor cleavage assay at multiple genomic loci. The specificity of iCas was tested using seven distinct guide RNAs (gRNAs), the results of which are shown in three-dimensional column graphs. It was found that iCas displayed variable specificity profiles for different gRNAs, which could be broadly divided into three groups: (a) highly specific, (b) moderately specific, and (c) unspecific. For the gRNAs targeting the EMX1 exonic locus and the second intronic site within the WAS gene, iCas exhibited almost no off-target effects for all durations of 4HT treatment tested. For the gRNAs targeting the first site within the VEGFA promoter, the TAT locus, and the FANCF locus, off-target effects were observed after 16 hours of 4HT treatment. For the gRNAs targeting the second site within the VEGFA promoter and the first intronic site within the WAS gene, off-target genome editing occurred at about the same time as the intended on-target genome modifications, regardless of how the duration of 4HT treatment was varied. ($n\geq 2$ replicates for each on-target site; $n\geq 3$ replicates for each EMX1 off-target site; $n\geq 1$ replicate for other off-target sites.)

Figure 20:
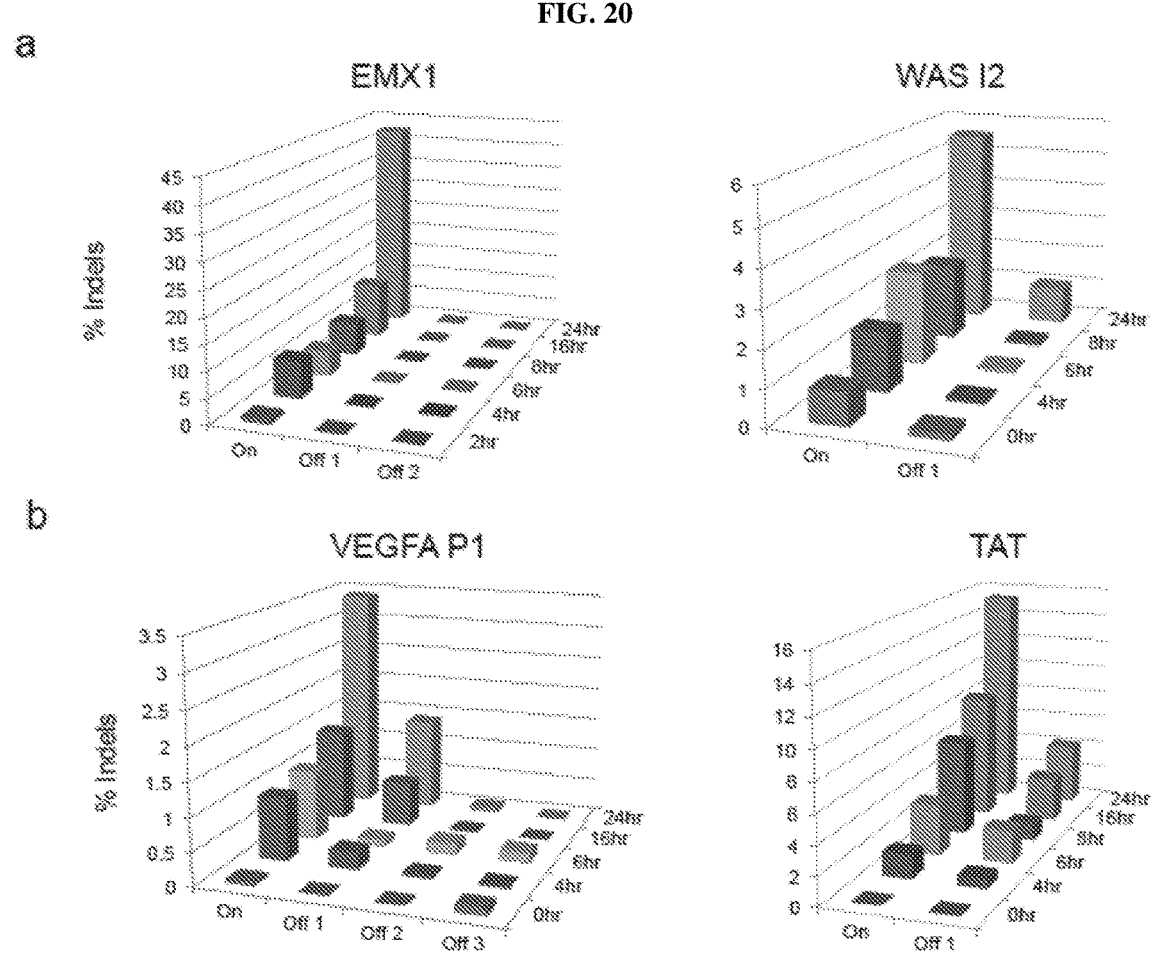
Figure 20:
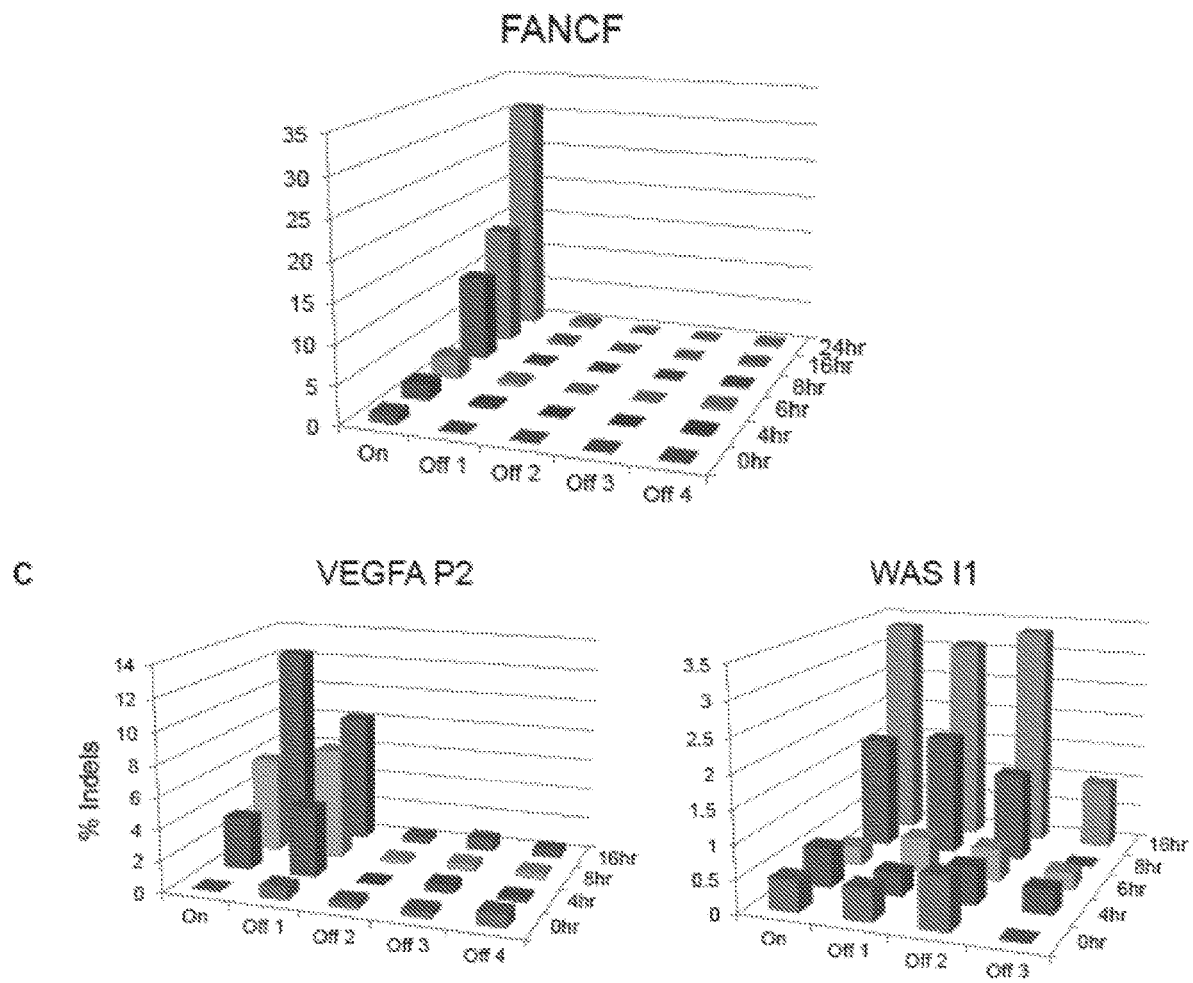

FIG. 20|Specificity of iCas evaluated by deep sequencing at multiple genomic loci. The gRNAs used were separated into three groups based on FIG. 17. The results from the deep sequencing experiments ($n\geq 1$ replicate for each data point) largely mirrored those obtained from the Surveyor assays. All the results are shown in three-dimensional column graphs. (a) The gRNAs targeting EMX1 and WAS intronic site 2 were highly specific. (b) The gRNAs targeting VEGFA promoter site 1 and TAT showed some off-target genome editing, which was generally less than the corresponding on-target modifications. However, unlike the Surveyor assay, only minimal off-target INDELS for the FANCF gRNA were observed using deep sequencing. (c) The gRNAs targeting VEGFA promoter site 2 and WAS intronic site 1 exhibited comparable on-target and off-target genome modifications, even with less than 8 hours of 4HT treatment. See Table 2 for details of the on-target and off-target sites.

Figure 21:
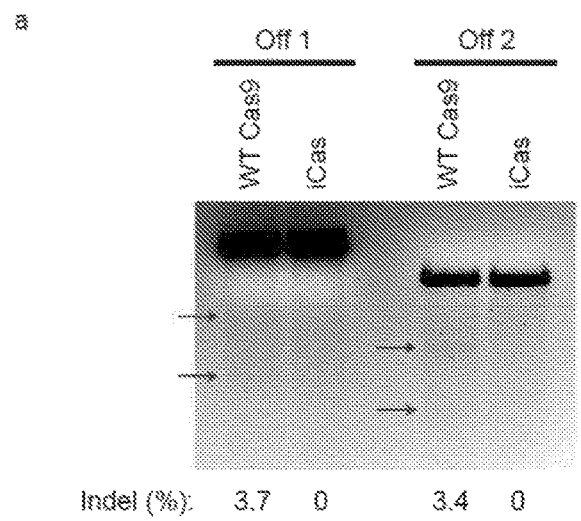
Figure 21:
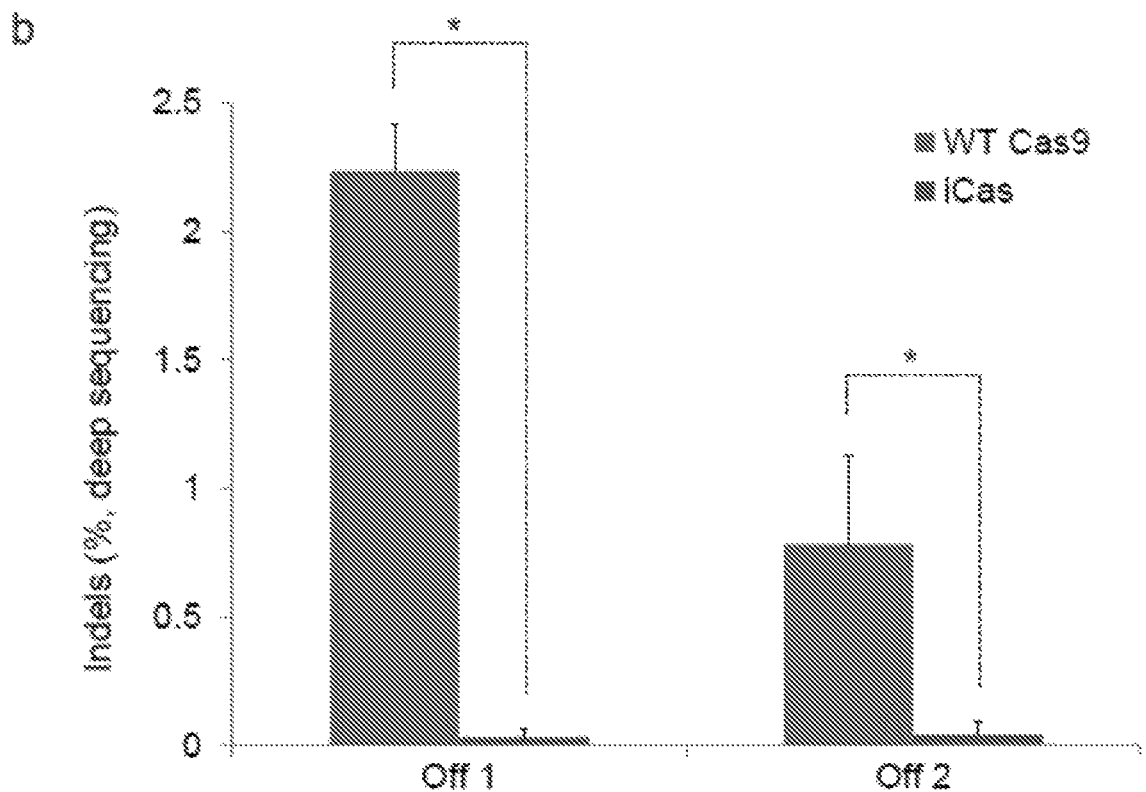

FIG. 21|Specificity of iCas in comparison with wildtype Cas9. To evaluate the specificity of wildtype Cas9 and iCas, (a) the Surveyor assay and (b) deep sequencing, respectively, were used to analyse two known off-target sites (Off 1 and Off 2) of the EMX1-targeting sgRNA, the data of which is shown as column graphs. From the Surveyor assay, cleavage bands were observed for wildtype Cas9 at both off-target sites as previously reported. However, the iCas system did not induce any observable genome modification at the two sites after 24 hours treatment with 1 µM 4HT. From deep sequencing data, it was shown that iCas produced INDELs at levels barely above background level at both off-target sites, while wildtype Cas9 generated significantly higher INDEL frequencies (* $P<0.005$, Student's t-test). Error bars reflect the standard deviation from at least two biological replicates.

Figure 22:
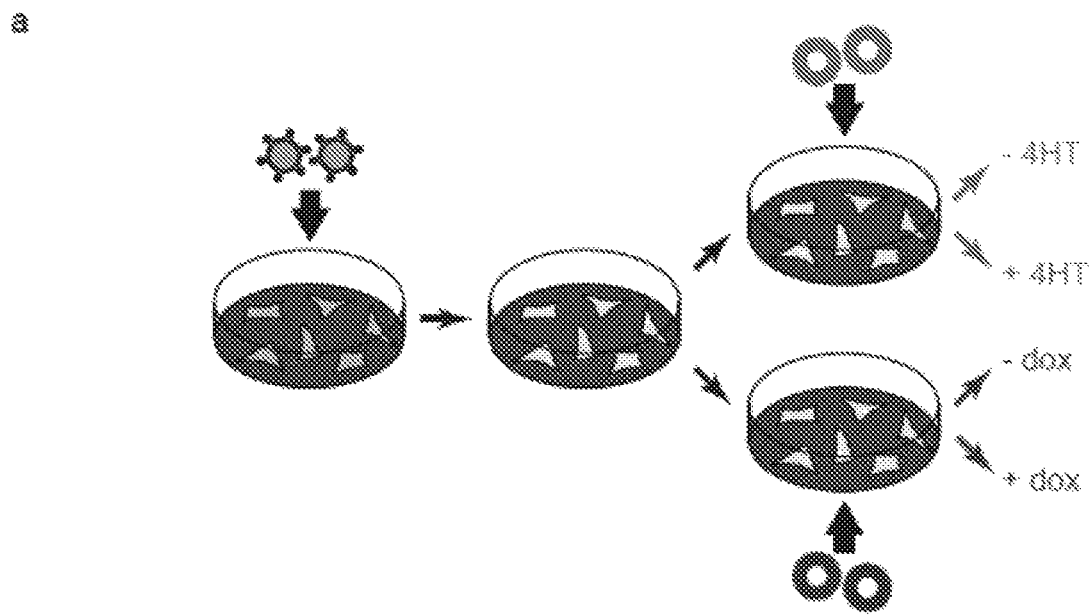
Figure 22:
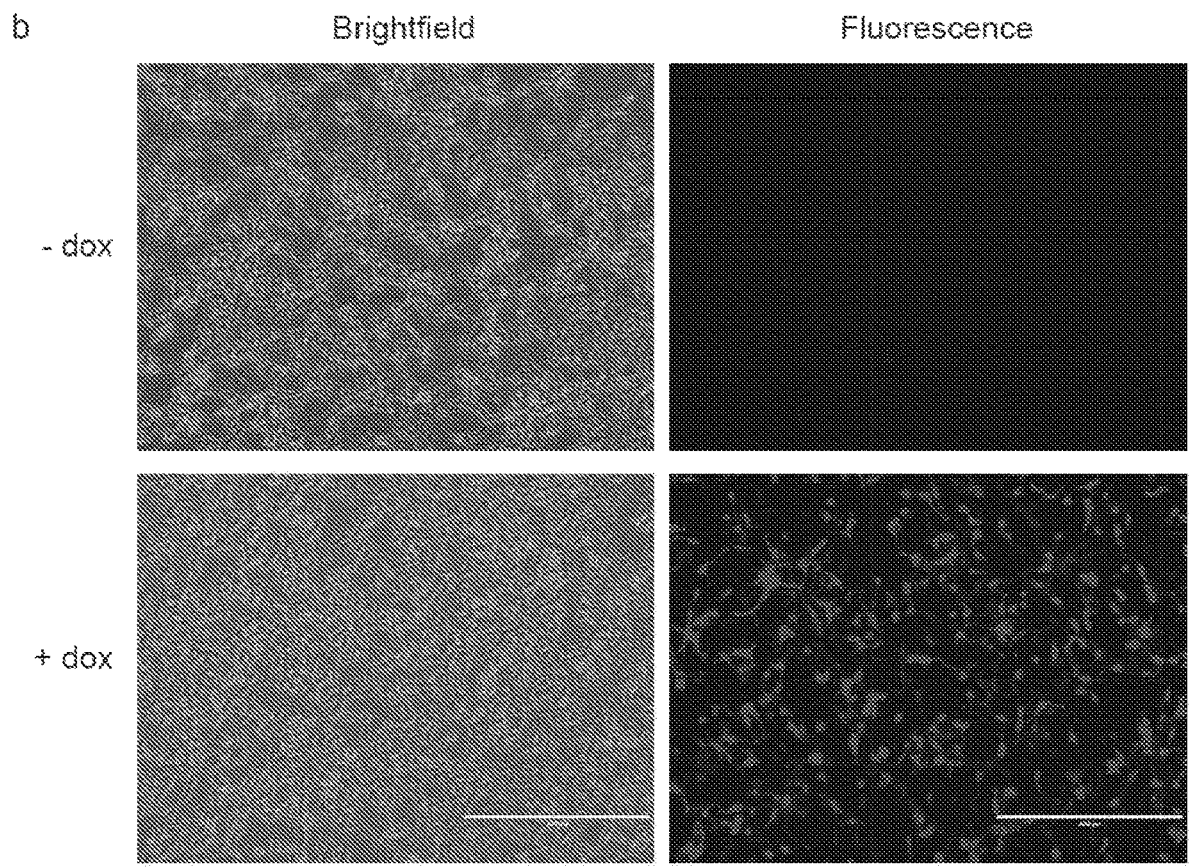

FIG. 22|Comparison of iCas with PTRE3G-Cas9. (a) shows a schematic overview of experimental setup for the comparative study. A previously reported STF3A cell line was engineered to stably produce the transactivator protein (Tet-On 3G) required for a functional doxycycline (dox)-inducible promoter ($P_{TRE3G}$). The STF3A cells carry a TCF/Lef responsive luciferase reporter and also express high levels of Wnt3a. The hexagons with small circles at their corners represent retroviruses used to stably integrate the transactivator gene into the genome of the STF3A cell line. The upper concentric circles denote plasmids encoding iCas, while the lower concentric circles denote plasmids encoding wildtype Cas9 under the control of $P_{TRE3G}$. (b) shows Brightfield and fluorescent images, showing expression of fluorescent signal in the cells, showing successful cell transfection and expression of the tdTomato gene. To evaluate the STF3A-TetOn cell line, the engineered cells were transfected with a plasmid carrying the tdTomato gene under the control of a doxycycline-inducible promoter. The cells exhibited a strong fluorescence signal upon treatment with doxycycline for 24 hours. In contrast, there was very little fluorescence signal in the absence of the chemical. Various concentrations of doxycycline, from 50 to 1000 ng/ml, were tested, all of which yielded similar fluorescence intensities (scale bar=400 µm).

Figure 23:
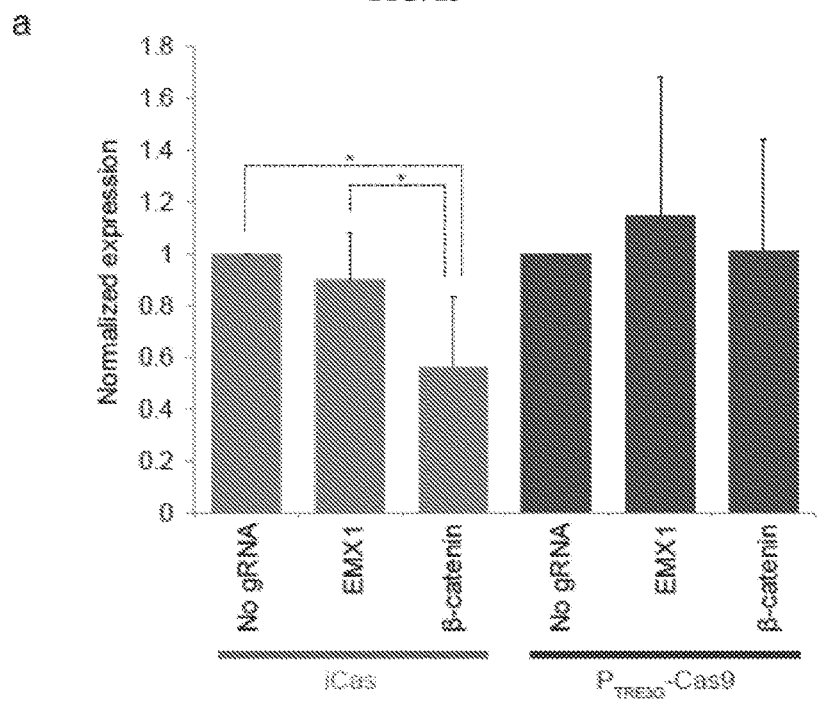
Figure 23:
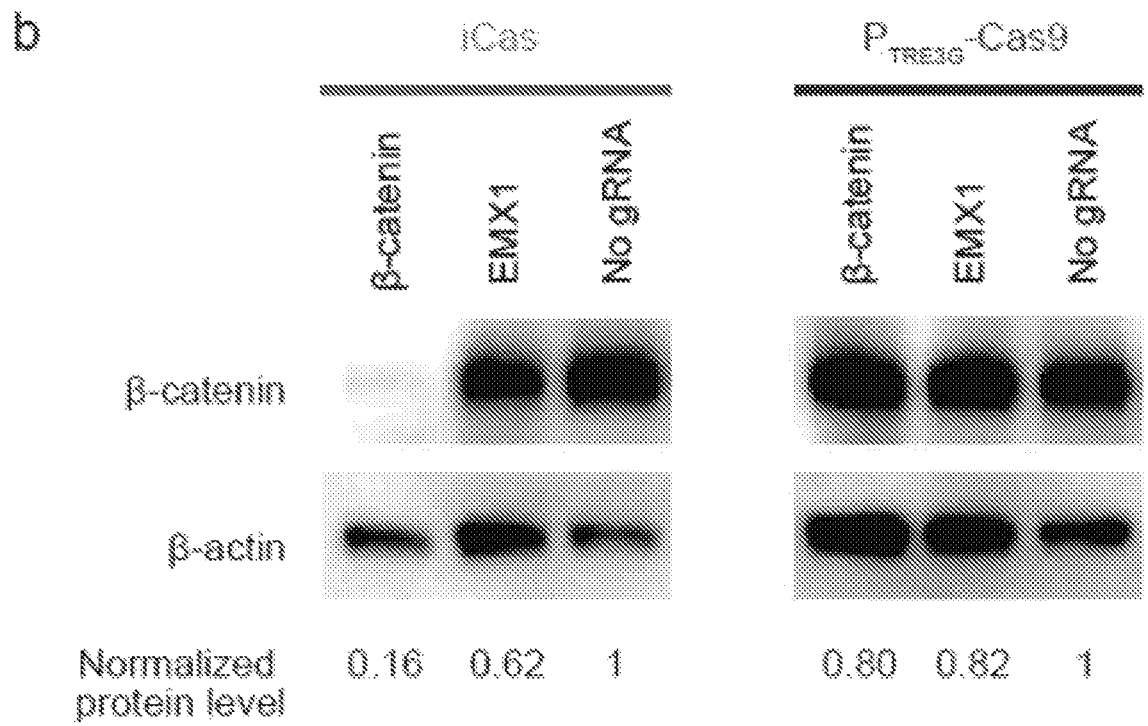

FIG. 23|Levels of β-catenin transcript and protein. (a) shows column graphs depicting the expression of β-catenin as assessed by quantitative real-time PCR (qRT-PCR). HEK293 cells were transfected with either iCas or PTRE3G-Cas9 and then treated with the corresponding inducer for 6 hours. Subsequently, they were harvested for analysis after another 72 hours. When the cells were co-transfected with iCas and a sgRNA targeting β-catenin, a significant decrease in the transcript level of β-catenin (* P<0.05, Student's t-test) was observed. Such a decrease was not observed for cells transfected with an EMX1-targeting sgRNA or with $P_{TRE3G}$-Cas9 instead of iCas. Error bars reflect the standard deviation from at least three biological replicates. (b) shows images of Western blots, showing the detected levels of β-catenin protein. In cells that were co-transfected with iCas and a β-catenin-targeting sgRNA, the amount of β-catenin protein dropped to less than 20% of the original level. Such a large decrease was absent from cells that were not transfected with the β-catenin-targeting sgRNA or were transfected with PTRE3G-Cas9 instead of iCas.

Figure 24:
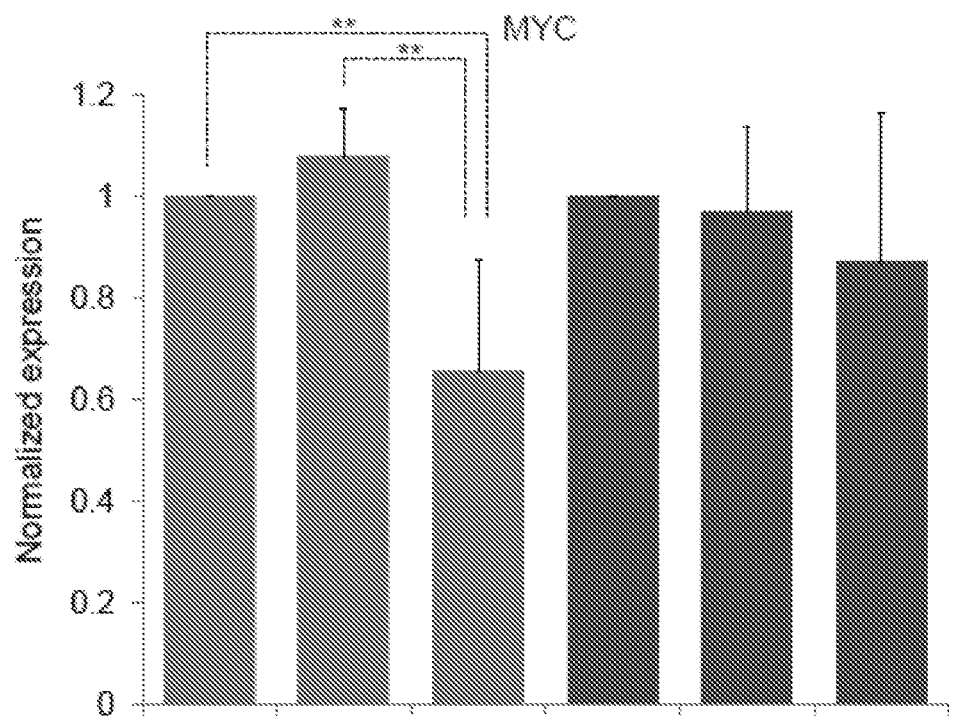
Figure 24:
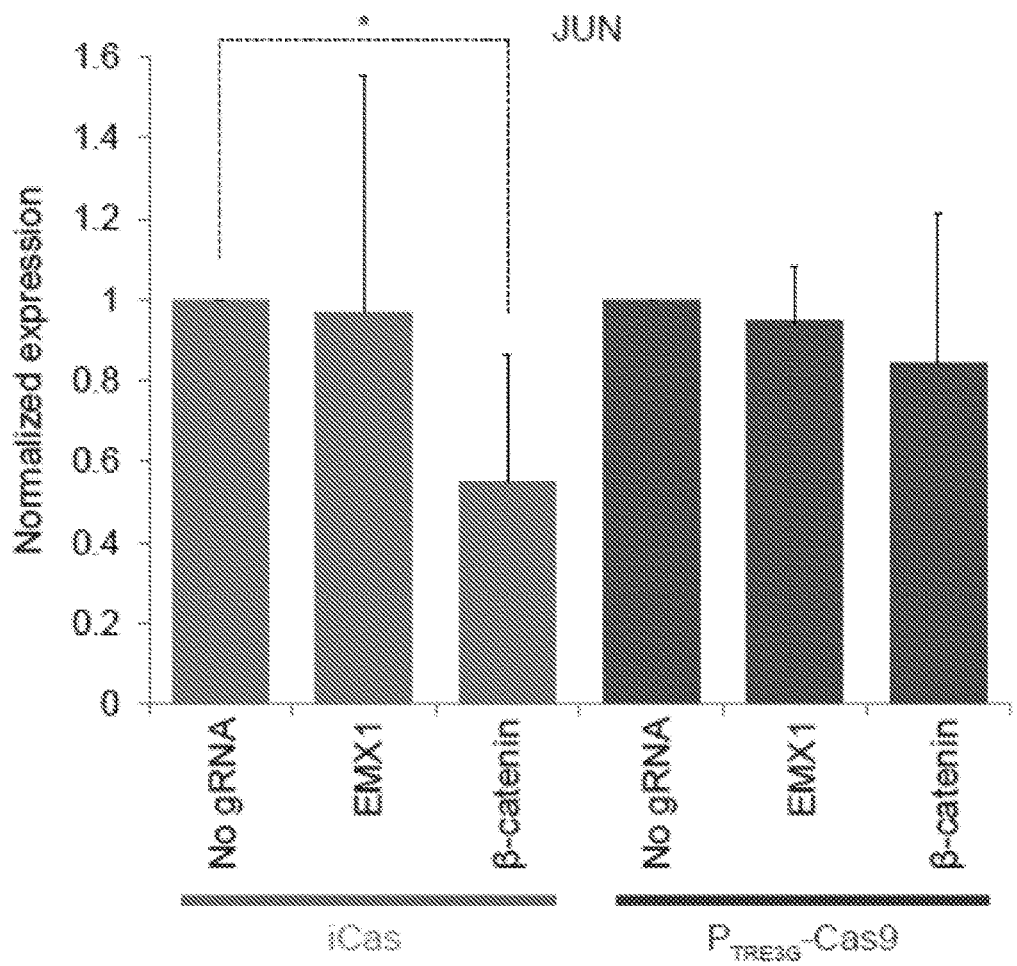

FIG. 24|Perturbation of Wnt signalling by iCas. The expression levels of two Wnt target genes, MYC and JUN, were measured using qRT-PCR and the data shown as column graphs. All measurements were normalized to those of the control samples (no sgRNA). The expression of MYC and JUN were significantly down-regulated in STF3A-TetOn cells that were transfected with both a plasmid encoding iCas and a sgRNA targeting β-catenin (* P<0.05, ** P<0.005, Student's t-test). Error bars reflect the standard deviation from at least three biological replicates.

Figure 25:
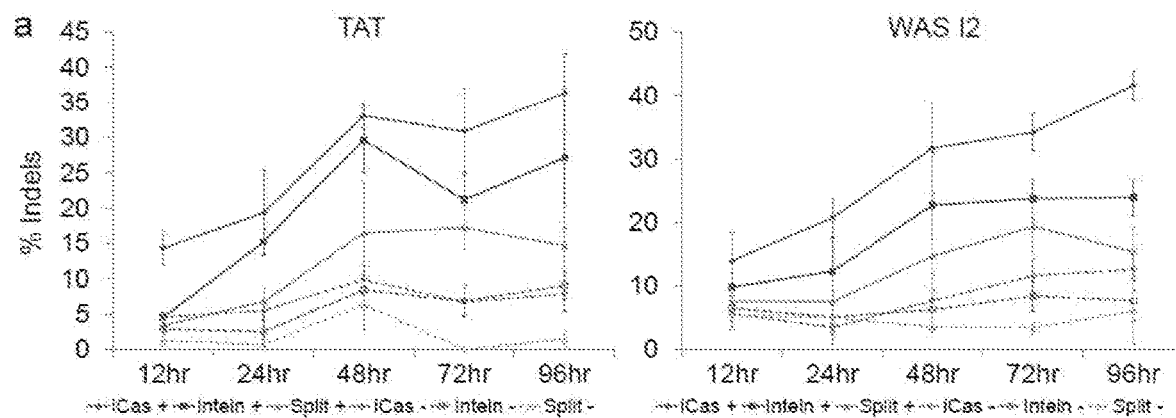
Figure 25:
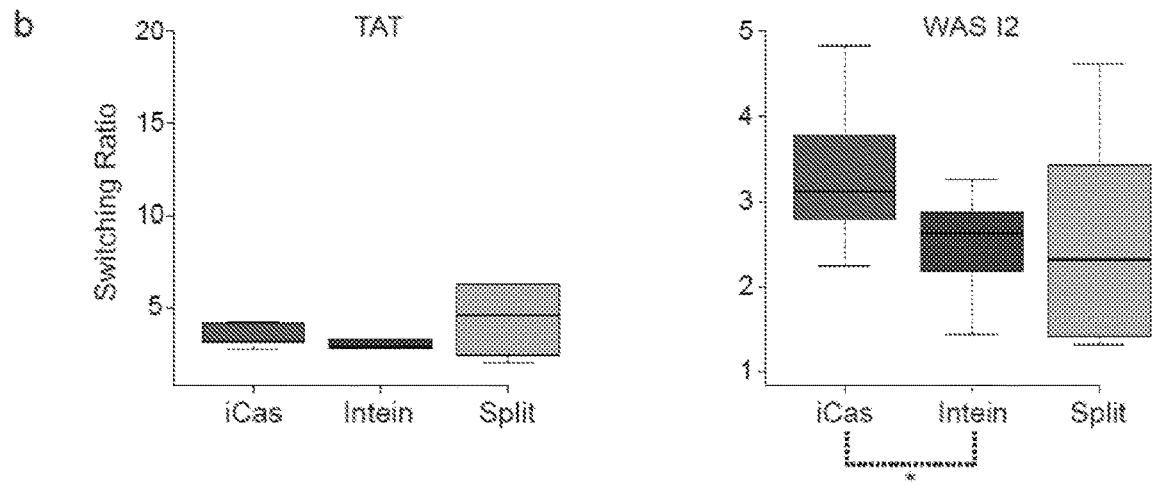

FIG. 25|Benchmarking three different conditional genome editing technologies by the Surveyor cleavage assay. (a) shows line plots depicting the change in % of INDELs present over time for various systems. The TAT and WAS genomic loci were targeted using iCas, intein-Cas9, or split-Cas9. Transfected HEK293 cells were treated with (solid lines) or without (dotted lines) the appropriate chemical inducer and harvested at 12, 24, 48, 72, or 96 hours after treatment. Upon activation, the iCas technology generated INDELS more rapidly than the other two systems. Error bars reflect the SEM from at least three biological replicates. (b) shows box plots depicting the switching ratios (extent of genome modification in the presence of inducer divided by extent of genome modification in the absence of inducer) at the TAT and WAS loci. Overall, the iCas system was turned on with comparable or higher efficiencies than intein-Cas9 and split-Cas9 upon addition of the appropriate inducer (* P<0.1, Student's t-test).

Figure 26:
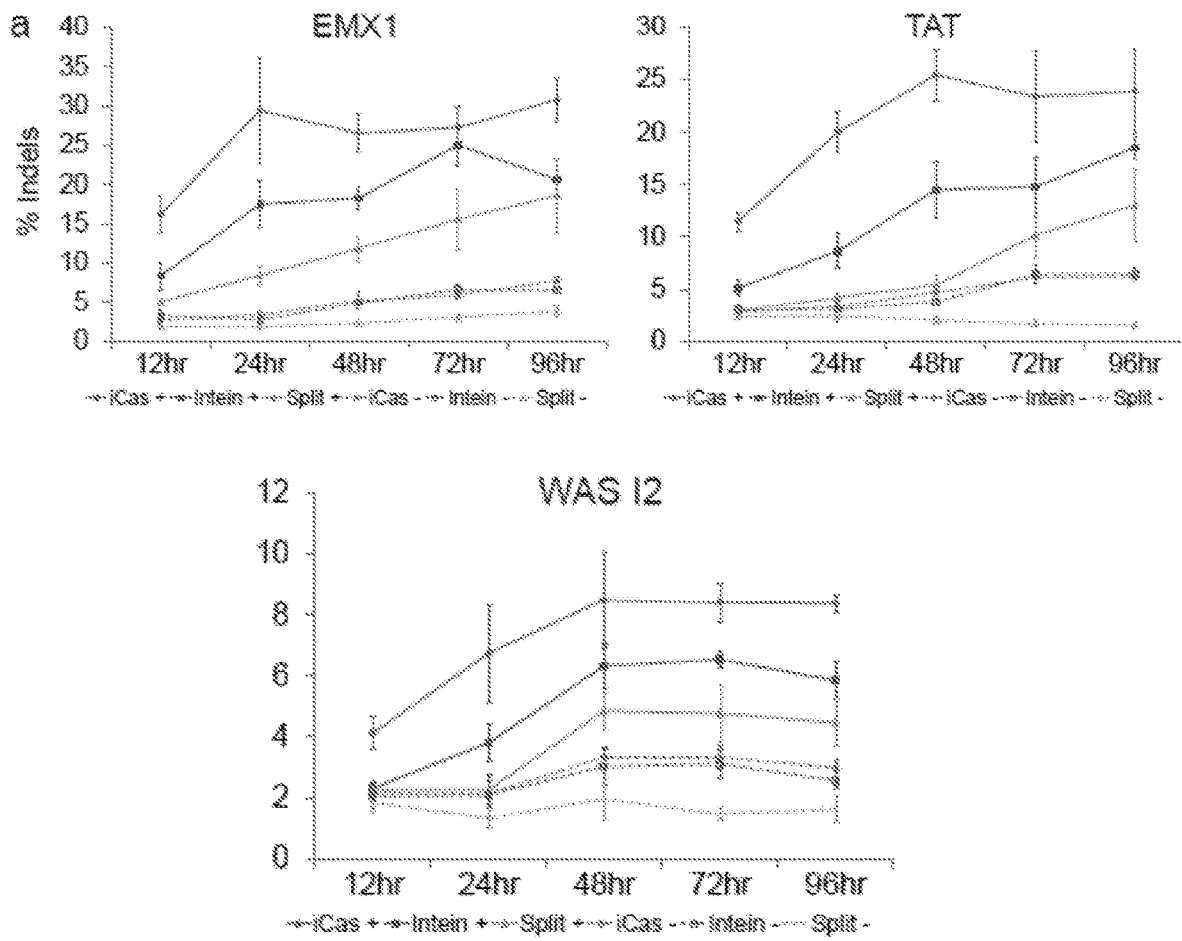

FIG. 26|Comparison of iCas with intein-Cas9 and split-Cas9. (a) shows line graphs depicting the quantification of INDEL frequency at the EMX1 (left panel), TAT (middle panel), and WAS loci (right panel) by deep sequencing. Transfected HEK293 cells were treated with (solid lines) or without (dotted lines) the appropriate chemical inducer and harvested at 12, 24, 48, 72, or 96 hours after treatment. The background activity of iCas and intein-Cas9 in the absence of 4HT were similar, but the iCas system exhibited higher editing activity upon addition of the inducer at all the three loci tested. Additionally, although the split-Cas9 architecture appeared to have the lowest amount of leakiness, its activity was switched on more slowly than iCas and intein-Cas9 after addition of the appropriate inducer. Notably, the frequency of INDELS generated by split-Cas9 after approximately 96 hours of induction could be readily achieved by iCas after only 12 hours of induction. Error bars reflect the SEM from at least three biological replicates. (b) shows box plots depicting the switching ratios at different genomic loci. Based on the deep sequencing measurements, the iCas system was turned on more efficiently than intein-Cas9 at all the loci tested upon addition of 4HT, while the split-Cas9 architecture outperformed intein-Cas9 at the WAS locus (* P<0.1,  P<0.05, * P<0.01, Student's t-test). (c) shows gel images evaluating the ability of iCas, intein-Cas9, or split-Cas9 to edit two genomic loci (EMX1 and TCF7) simultaneously upon 24 hours of inducer treatment. Based on data gathered from the Surveyor cleavage assay, genome modification was observed at both the targeted loci for iCas. In contrast, intein-Cas9 only produced cuts at the EMX1 locus but not at the TCF7 locus, while no genome modification was detected for split-Cas9 at both the targeted loci. Arrows indicate the expected cleavage bands.

FIG. 27|Temporal switching of iCas activity. (a) shows gel images depicting the results of the integration of the iCas system into HEK293 cells using retroviral transduction. To assess the functionality of this cell line, a lentivirus expressing a sgRNA targeting one of the coding exons of the PARP4 gene was generated, and HEK293-iCas cells were infected the virus. After puromycin selection and continuous passaging of the cells for at least two weeks, the cells were treated with or without 1 µM 4HT for 24 hours before harvesting them for analysis using the Surveyor assay. Cleavage bands (indicated by arrows) were observed for the treated cells, but not for the untreated cells, indicating that the level of leakiness is sufficiently low to minimize unwanted genome editing in the absence of the inducer. (b) shows a schematic outlining the experiment to toggle the activity of iCas on-off-on. When the cells are treated with 4HT, the iCas enzyme is expected to translocate into the nucleus and be able to edit the DNA (these cells are depicted as yellow). However, when the inducer has been removed for more than 72 hours, the iCas protein is expected to translocate out of the nucleus and thus no more editing will be anticipated.

Figure 28:
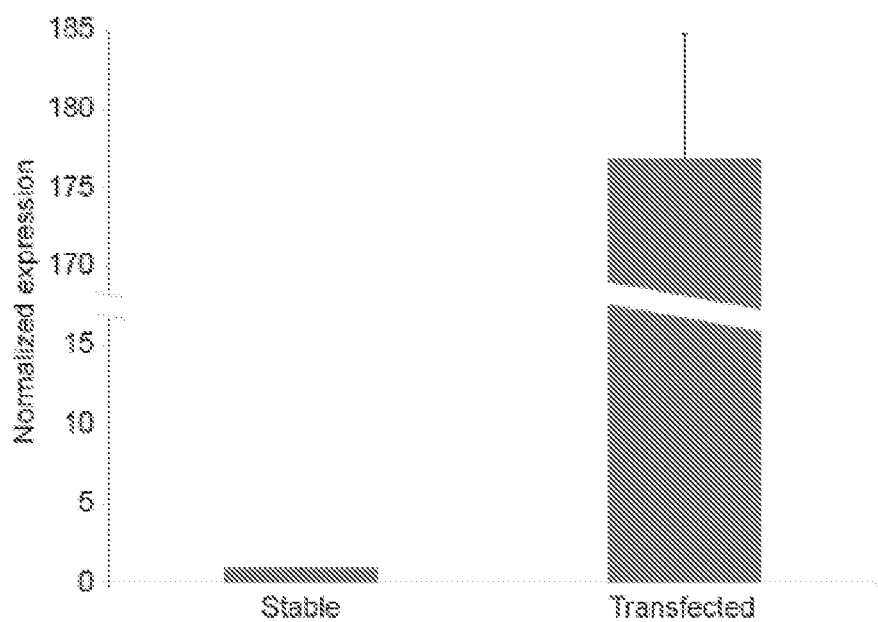

FIG. 28|Levels of iCas transcript in a stable line and during transfection. Column graphs here show the quantification of the expression of iCas using qRT-PCR. In comparison to the HEK293-iCas stable line, the transcript level of the editing enzyme was found to be more than a hundred fold higher, compared to when an iCas-bearing plasmid was transfected into wildtype HEK293 cells. Cells were harvested 72 hours after transfection (n=3 biological replicates).

Figure 29:
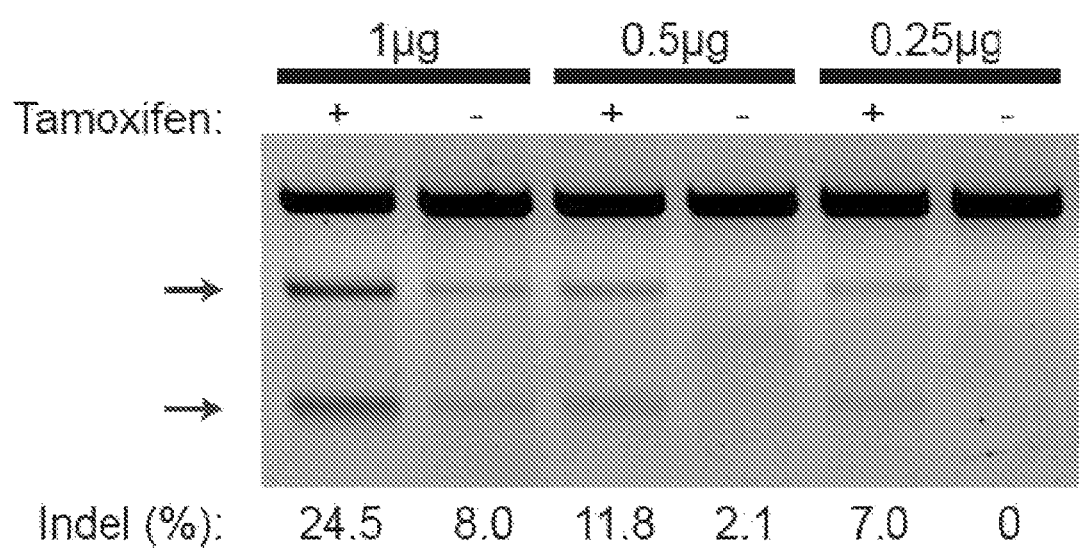

FIG. 29|Effect of enzyme dosage on the level of background activity, shown as gel images. Different amounts of an iCas-bearing plasmid were transfected together with an EMX1-targeting sgRNA into HEK293 cells. These cells were harvested 96 hours after transfection for the Surveyor cleavage assay. DNA modification was clearly observed when 1 µg of plasmid was utilised, even in the absence of the inducer. Importantly, background editing activity at the EMX1 locus was noticeably reduced when 0.5 µg or 0.25 µg plasmid was used instead. The switching ratio was improved from 2.83 to 4.16 and 7.96 respectively. Hence, these results indicate that the extent of leakiness may be modulated by adjusting the dosage of the iCas enzyme. Arrows indicate the height of the expected cleavage bands.

Figure 4:
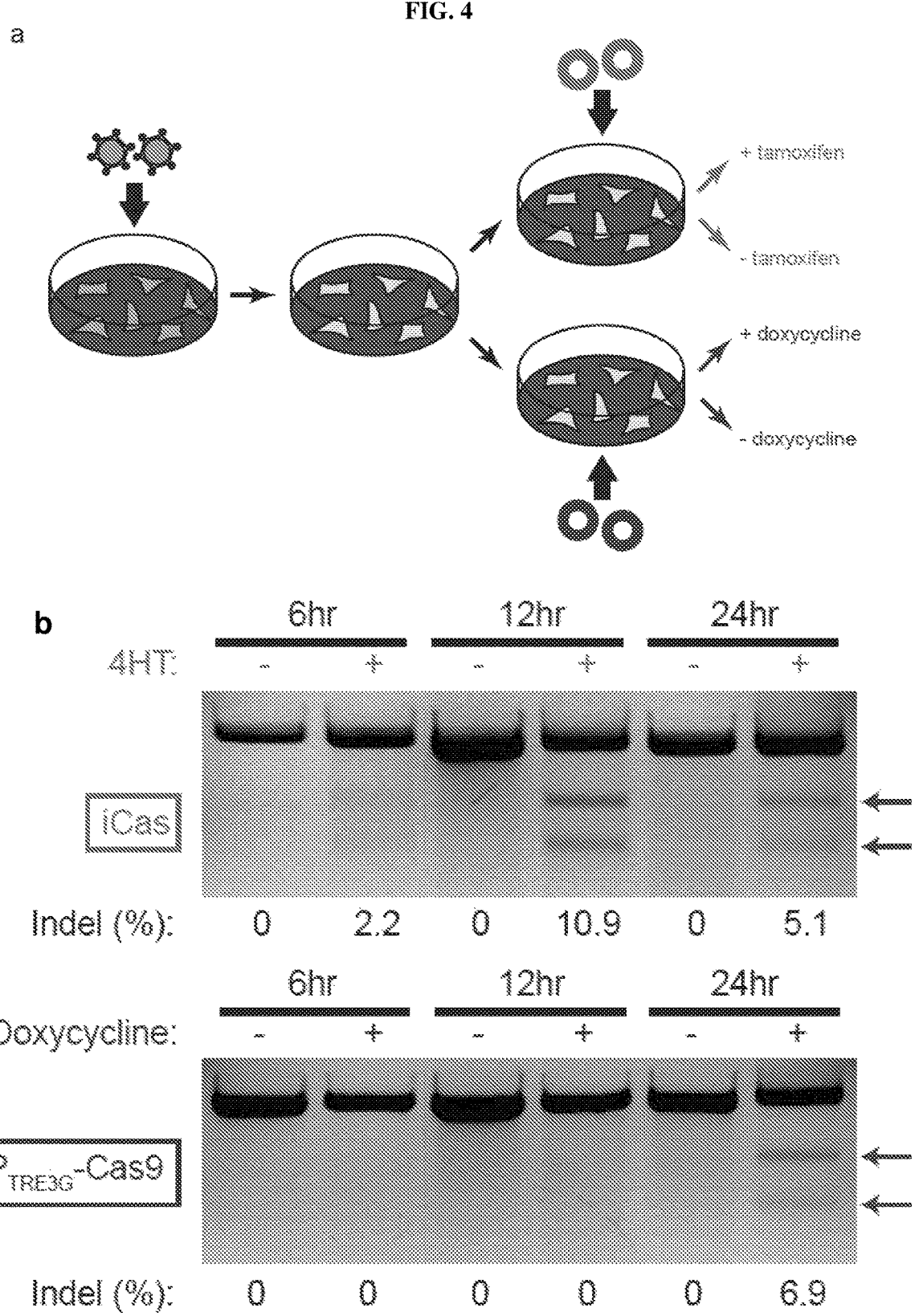
FIG. 4|Comparison of iCas with an alternative inducible promoter-based system. (a) Overview of experimental setup for the comparative study. STF3A cells were engineered to stably produce the transactivator protein (Tet-On 3G) required for a doxycycline-inducible promoter ($P_{TRE3G}$) to be functional. The hexagons with small circles at their corners represent retroviruses used to stably integrate the transactivator gene into the genome of the STF3A cell line. The upper concentric circles denote plasmids encoding iCas, while the lower concentric circles denote plasmids encoding wildtype Cas9 under the control of $P_{TRE3G}$. (b) Detection of genome modification at the CTNNB1 locus by Surveyor assay. Arrows indicate the expected cleavage bands. The full gel image is shown in FIG. 28. (c) Repression of Wnt signaling pathway assayed by a Wnt-responsive luciferase reporter. A plasmid encoding either iCas (light) or PTRE3G-Cas9 (dark) was transfected into STF3A-Tet-On cells with or without sgRNA. The transfected cells were treated with 4-HT or dox for 6 h and harvested after another 72 h. All luciferase readings were normalized to those from control samples (no sgRNA). Data represent mean±s.d. of 5 biological replicates ($P<0.005$, *$P<0.001$, Student's t-test). (d) Expression of CCND1, a Wnt target gene, measured by quantitative real-time PCR. Data represent mean±s.d. of 5 biological replicates (*$P<0.05$, Student's t-test).
Figure 30:
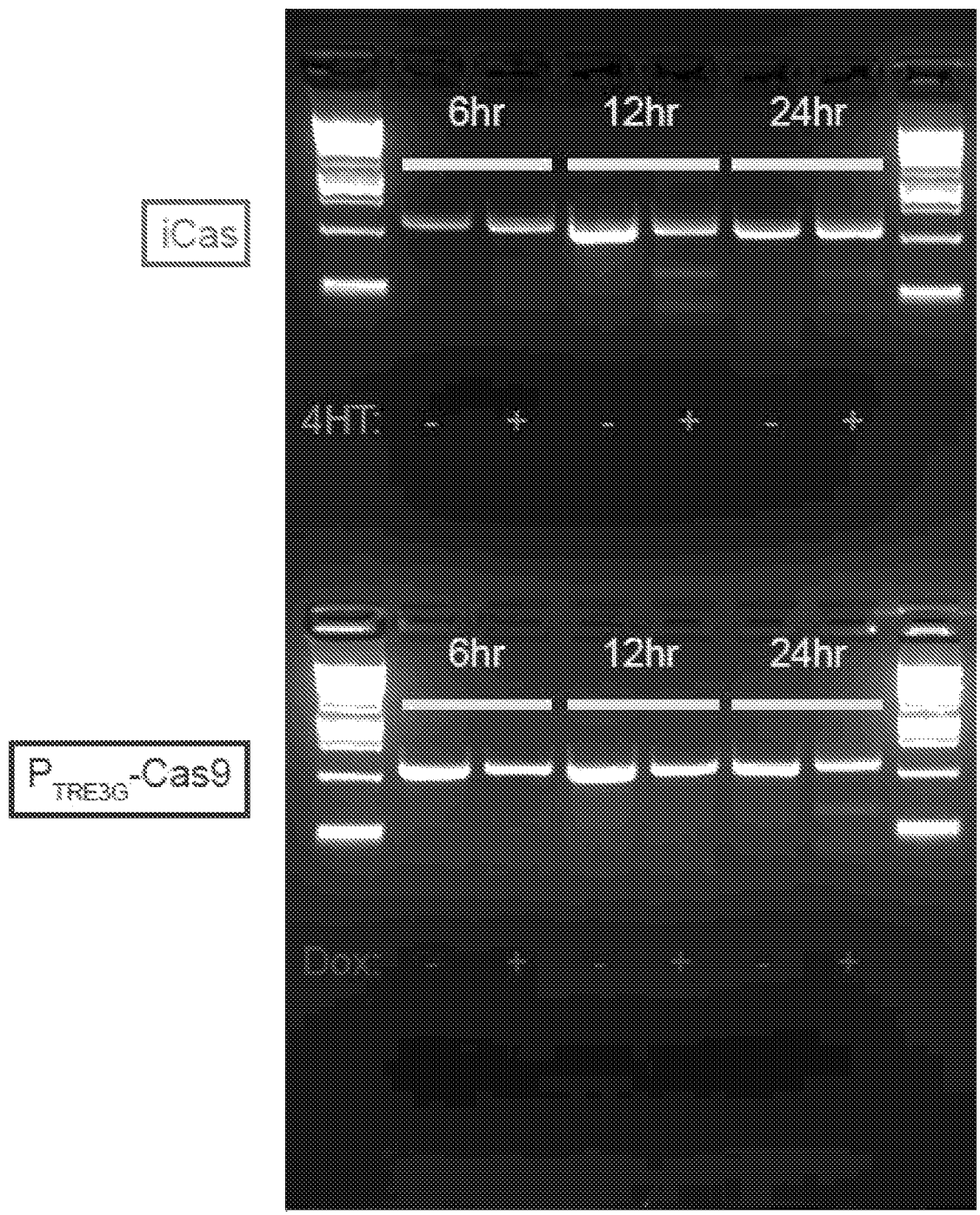

FIG. 30|Detection of genome modification at the β-catenin locus using the Surveyor assay, the results of which are shown as an agarose gel image. The uncropped full gel image corresponding to the image shown in FIG. 4a is shown.

FIG. 31|Evaluating the ability of iCas, intein-Cas9, or split-Cas9 to edit two genomic loci simultaneously, the results of which are shown as agarose gel images. (a) Cells were treated with the appropriate inducer for 12 hours. The uncropped full gel images corresponding to FIG. 5c are shown. (b) Cells were treated with the appropriate inducer for 24 hours. The uncropped full gel images corresponding to FIG. 5d are shown.

Figure 32:
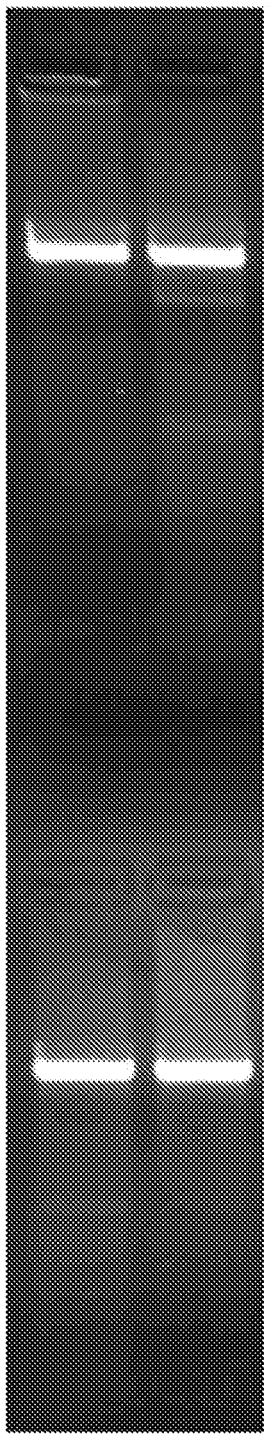

FIG. 32|Detection of genome modification using the Surveyor cleavage assay to demonstrate that iCas activity could be switched on and off repeatedly, as shown in the presented gel image. The uncropped full gel image corresponding to FIG. 6c is shown.

DETAILED DESCRIPTION OF THE PRESENT INVENTION

Recently, the development of genome editing technologies has opened up new avenues of biomedical research and holds the promise to accelerate knowledge discovery and drug development. The CRISPR-Cas9 system, for example, which is co-opted from bacteria, is particularly attractive because the elements that recognize the target genomic loci are simple single guide RNA (sgRNA) molecules, which bind the loci-of-interest by complementary base-pairing and are hence straightforward to design and synthesize. The sgRNA recruits the Cas9 nuclease to the DNA to create a double-stranded break. Much effort has been devoted to improving the specificity of the technology and various strategies have been proposed to mitigate off-target mutagenesis by the Cas9 enzyme.

In one aspect, the present invention refers to an endonuclease-based gene editing construct. As used herein, the term "endonuclease(s)" refers to enzymes that are capable of "cleaving"/"restricting", that is inducing a strand break, in a section of a nucleic acid sequence. Depending on the type of endonuclease required, the endonuclease can be capable of cleaving within a single strand region of a nucleic acid sequence, a double strand region of a nucleic acid sequence or both. In general, endonucleases can be divided into 3 types, that is Type I, II and III, according to their mechanism of action. Type I and type III nucleases typically refer to large multi-subunit endonucleases that have both endonuclease and methylase activity (that is ATP [adenosine triphosphate] is required as a source of energy). Type II endonucleases, on the other hand, are simpler in structure and do not require an energy source such as ATP. The type of restriction site and specificity of the endonuclease to its particular restriction site, that is the site where the strand break is induced, varies between each endonuclease. It is also possible for an endonuclease to cleave the nucleic acid strand a number of base pairs upstream or downstream from the recognition site. For example, Type I endonucleases are known for cleaving random nucleic acid sequences up to 1000 or more base pairs upstream and/or downstream from the recognition site. Type III endonucleases, on the other hand, are known for cleaving nucleic acid sequences up to 25 or more base pairs from the recognition sites. Thus, in one example, the endonuclease is, but is not limited to, CRISPR-associated endonuclease, for example Cas9 and Cpf1, or derivatives thereof.

As used herein, the term "CRISPR" refers to Clustered regularly interspaced short palindromic repeats, which are segments of prokaryotic DNA containing short repetitions of base sequences. Each repetition can be followed by short segments of spacer DNA within a sequence. The term "Cas9" refers to CRISPR associated protein 9, which is an RNA-guided DNA endonuclease enzyme associated with the CRISPR (Clustered Regularly Interspaced Short Palindromic Repeats) type II adaptive immunity system in, for example, *Streptococcus pyogenes*, among other bacteria. *S. pyogenes* utilizes Cas9 to interrogate and cleave foreign DNA, such as invading bacteriophage DNA or plasmid DNA. Cas9 interrogates the foreign DNA by unwinding it and checking whether the foreign DNA is complementary to the 20 base pair spacer region of the guide RNA. If the interrogated DNA substrate is complementary to the 20 base pair spacer region of the guide RNA, Cas9 cleaves the invading DNA. Mechanistically speaking and without being bound by theory, the CRISPR-Cas9 mechanism has a number of parallels with mechanism of the RNA interference (RNAi) present in eukaryotes.

Thus, in one example, the CRISPR-associated endonuclease, or derivative thereof, is selected from the group consisting of a wild type CRISPR-associated protein 9 (Cas9), a mutated CRISPR-associated protein 9 (Cas9), a wild type Cpf1 (CRISPR from *Prevotella* and *Francisella* 1) protein, and a mutated Cpf1 protein, In the event where the protein is mutated, the mutant protein is to be functional. In another example, the wherein the CRISPR-associated protein 9 (Cas9), or derivative thereof, is selected from the group consisting of *Streptococcus pyogenes, Streptococcus thermophiles, Listeria innocua, Staphylococcus aureus* and *Neisseria meningitidis*. In yet another example, the CRISPR-associated protein 9 (Cas9), or derivative thereof, has at least 99%, at least 98%, at least 97%, at least 96%, at least 95%, at least 94%, at least 93%, at least 92%, at least 91%, at least 90%, at least 89%, at least 85%, at least 80%, at least 75%, sequence identity to SEQ ID NO: 1. In yet another example, the CRISPR-associated protein 9 (Cas9), or derivative thereof, has at least 95% sequence identity to SEQ ID NO: 1. In a further example, the Cpf1 protein, or derivative thereof, is selected from the group consisting of *Acidaminococcus, Lachnospiraceae, Parcubacteria, Butyrivibrio proteoclasticus,* Peregrinibacteria, *Porphyromonas crevioricanis, Prevotella disiens, Moraxella bovoculi, Smithella, Leptospira inadai, Francisella novicida, Candidatus Methanoplasma termitum* and *Eubacterium eligens*. In another example, the Cpf1 protein, or derivative thereof, has at least 99%, at least 98%, at least 97%, at least 96%, at least 95%, at least 94%, at least 93%, at least 92%, at least 91%, at least 90%, at least 89%, at least 85%, at least 80%, at least 75% sequence identity to SEQ ID NO: 2 or 3. In another example, the Cpf1 protein, or derivative thereof, has at least 95% sequence identity to SEQ ID NO: 2 or 3 The term "sequence identity" means that two nucleic acid or amino acid sequences are identical (i.e., on a nucleotide-by-nucleotide or residue-by-residue basis) over the comparison window. The term "percentage of sequence identity" is calculated by comparing two optimally aligned sequences over the window of comparison, determining the number of positions at which the identical nucleic acid base (e.g., A, T, C, G, U, or I) or residue occurs in both sequences to yield the number of matched positions, dividing the number of matched positions by the total number of positions in the comparison window (i.e., the window size), and multiplying the result by 100 to yield the percentage of sequence identity. In light of the above, it is understood to a person skilled in the art what is meant by a sequence identity of, for example, at least 95%.

The terms "upstream" or "downstream" refer relative positions in nucleic acid sequence, that is in a DNA or RNA sequence. Each strand of DNA or RNA has a 5' end and a 3' end, which are so named for the carbon position on the deoxyribose (or ribose) ring. By convention, upstream and downstream relate to the 5' to 3' direction in which RNA transcription takes place. In this case, upstream is toward the 5' end of the RNA molecule and downstream is toward the 3' end of the RNA molecule. When considering double-stranded DNA, upstream is toward the 5' end of the coding strand for the gene in question and downstream is toward the 3' end. Due to the anti-parallel nature of DNA, this means the 3' end of the template strand is upstream of the gene and the 5' end is downstream. It is noted that some genes on the same DNA molecule may be transcribed in opposite directions. This means the upstream and downstream areas of the molecule may change depending on which gene is used as the reference.

In order for such an endonuclease-based gene editing construct to be functional, other factors may be required, other than the endonuclease itself. In the case of, for example, CRISPR-associated endonucleases, such as Cas9 or Cpf1, a guide nucleic acid sequence is required in order to guide the endonucleases to the correct excision or editing loci. Therefore, the endonuclease needs to be capable of cleaving a nucleic acid in a specific section marked by the binding of, for example a guide nucleic acid sequence. In one example, a single strand guide nucleic acid sequence would bind to a complementary sequence within a genome or a stretch of nucleic acid. This binding of the guide sequence to the genome results in a double strand nucleic acid section, which is then recognized by the endonuclease and is then targeted for excision. Thus, in one example, the sequence of the guide nucleic acid sequence is complementary to the sequence of the intended restriction site. In another example, the sequence of the guide nucleic acid sequence is identical to the sequence of the intended restriction site. In another example, more than one nucleic acid guide sequences are used in conjunction with one or more nucleases. In another example, for example when multiple endonucleases are used, the guide sequences are specific for each endonuclease. In another example, where a single endonuclease and multiple guide sequences are used, the guide sequences must be so constructed that the endonuclease is capable of restricting the nucleic acid sequence at all of restriction sites. Therefore, by delivering, for example, a Cas9 endonuclease and appropriate guide nucleic acid sequence into a cell, the cell's genome can be cleaved at a desired location, thereby allowing existing genes to be removed and/or new genes to be added, or the function of existing genes to be modulated. In terms of the present invention, the process of gene editing becomes simplified in terms of procedure, because the sgRNA molecules guide the Cas9 nuclease to the (then double strand) loci within the genome, which is then excised from that location. This removes the double strand section from the loci in question, thereby creating, for example, a gene knock-out or knock-down for situations where the sgRNA binds to a functional part of a gene, or a gene knock-in in the event that a gene is introduced into the restriction site.

There are various ways of controlling or inducing certain aspects of a biological system. For example, the use of the lac operon system is frequently used for prokaryotic gene regulation, as it allows for an effective, inducible regulatory mechanism based on the absence or the presence of lactose. In general, such systems can be described using the terms "inducible" and "repressible" systems, whereby an inducible system is off unless there is the presence of a control molecule (also called an inducer) that allows for, in this case, gene expression. The molecule is said to "induce expression". On the other hand, a repressible system is on except in the presence of some molecule (also called a co-repressor) that suppresses, in this case gene expression. The molecule is said to "repress expression". In both cases, the manner by which the induction or repression happens is dependent on the control mechanisms, as well as differences between prokaryotic and eukaryotic cells. Another example of an inducible expression system is tetracycline controlled transcriptional activation, wherein the activation of transcriptional activity is dependent on the presence of tetracycline. Having said that, these "on and off" switches that are usually found in the field of protein expression can be used in other situations where control over a specific enzyme function is desired. In one example, the inducible system used is the ERT2-tamoxifen inducible system. This system allows for temporal control of the enzyme in questions, as the ERT-domain can be fused to any protein of interest, allowing reversible control over their activity by administrating or removing tamoxifen, (or derivatives thereof, for example, 4-hydroxytamoxifen), that is the inducing agent that either switches the control of the target protein on or off, depending on the concept used. For example, without being bound by theory, it is thought that in the constructs disclosed herein, the ERT2 domains effectively sequester the Cas9-dependent constructs outside of the nucleus, where they cannot perform their DNA editing activity. In the presence of an inducing agent, for example tamoxifen, however, the fusion protein can then rapidly translocate into the nucleus to perform its function.

As explained previously, the inducing agent used would depend on the type of inducible/repressible system used. Also, in order to be able to function as an inducing agent, the compound which is to function as an inducing agent need to be small enough in order to penetrate the cell membrane and thereby be present in the cell cytoplasm, or even the cell nucleus, depending on where the expressed protein is found. In one example, the construct as disclosed herein comprises the following components: a CRISPR-associated endonuclease (such as Cas9 or Cpf1) or a derivative thereof; and at least one or more hormone binding domains of the estrogen receptor (ERT2) or derivatives thereof. In one example, the one or more hormone binding domains of the estrogen receptor (ERT2) are located upstream or located downstream of the CRISPR-associated endonuclease. In another example, if there are two or more ERT2 present in the construct, the ERT2 are all located upstream, or all located downstream, or located both upstream and downstream of the CRISPR-associated endonuclease. In another example, the hormone binding domains of the estrogen receptor (ERT2) is mutated. In yet another example, the mutated hormone binding domain of the estrogen receptor (ERT2) is SEQ ID NO: 4, or derivatives, or variations thereof. In one example, the inducing agent is, but is not limited to, tamoxifen, 4-hydroxytamoxifen or derivatives thereof. In another example, the inducing agent is 4-hydroxytamoxifen.

The concentration of the inducing agent used or required in order to control the protein in question depends on the inducing agent used, as well as the time in which the host cell is exposed to the incubating agent. It will be appreciated that the inducing agent may not be used in concentrations that may result in a toxic or adverse effect in the host cell. Thus, in one example, the concentration of the inducing agent used is 0.5 µM, about 0.25 µM, about 1 µM, about 1000 nM, about 500 nM, about 250 nM, about 100 nM, about 50 nM, about 25 nM or about 10 nM. In another example, the concentration of the inducing agent used is a concentration of about 1p M. It will also appreciated that the length of time a host cell is exposed to an incubating agent may have an effect on the length of time the inducible or repressible system is turned on, or off, respectively. Thus, in one example, the host cell is incubated with the inducing agent for about 2, about 3, about 4, about 5, about 5.5, about 6, about 6.5, about 7, about 7.5, about 8, about 8.5, about 9, about 12, about 16, about 23.5, about 24, about 24.5, about 36 or about 48 hours. In another example, the host cell is incubated with the inducing agent for about 4, about 6, about 8 or about 12 hours.

As used herein, the term "localization sequence" refers to an amino acid sequence which 'tags' a protein for transport into a specific compartment of the cell or the cell nucleus. One example of a localization sequence is a nuclear localization sequence or signal (NLS), which tags a protein for import into the nucleus of the cell. Another example is a nuclear export signal (NES), which has the opposite function in that it tags a protein for export out of the nucleus into the cytoplasm. Nuclear localization sequences can be divided into non-classical and classical NLSs. Classical nuclear localization sequences, that is NLSs that use the classical nuclear import cycle which may require the presence of an importin protein, can be further classified as either monopartite (which means to have a single part) or bipartite (to have more than one part, in this case two parts). For example, the sequence PKKKRKV (SEQ ID NO: 393) in the SV40 Large T-antigen is considered to be a monopartite NLS. The NLS of nucleoplasmin, KR[PAATKKAGQA]KKKK (SEQ ID NO: 394), is an example of a bipartite signal, wherein two clusters of basic amino acids are present, separated by a spacer of about 10 amino acids. It is noted that this spacer may be variable in length. Examples of nuclear localization signals are, but are not limited to the nuclear localization signals of SV40 large T-Antigen (monopartite; PKKKRKV (SEQ ID NO: 393) or CGGGPKKKRKVED (SEQ ID NO: 395)), c-myc (monopartite; PAAKRVKLD (SEQ ID NO: 396)), and nucleoplasmin (bipartite; AVKRPAATKKAGQAKKKKLD (SEQ ID NO: 397) or KRPAATKKAGQAKKKK (SEQ ID NO: 394)); EGL-13 (monopartite; MSRRRKANPTKLSENAKKLAKEVEN (SEQ ID NO: 398)) and TUS-protein (monopartite; KLKIKRPVK) (SEQ ID NO: 399). In another example, the nuclear localization signals (NLSs) are classical NLSs (cNLS) or proline-tyrosine (PY)-NLS. In yet another example, the nuclear localization signals (NLSs) are monopartite or bipartite NLSs. In a further example, the nuclear localization signal is, but is not limited to, the nuclear localization signal of the Large T-antigen of the Simian Vacuolating Virus 40 (SV40), nucleoplasmin, importin α, EGL-13, c-MYC, TUS, AR, PLSCR1, PEP, TPX2, RB, TP53, N1N2, PB2, CBP80, SRY, hnRNP A1, HRP1, Borna Disease Virus p10, Ty1 Integrase, and the Chelsky consensus sequence. As used herein, in regards to NLS, the term signal and sequence is used interchangeably. In yet another example, the nuclear localization sequence (NLS) is SEQ ID NO: 5 or SEQ ID NO: 6.

There are many other types of NLS, such as the acidic M9 domain of hnRNP A1, the sequence KIPIK in yeast transcription repressor Matα2, and the complex signals of U snRNPs. Most of these NLSs appear to be recognized directly by specific receptors of the importin β family without the intervention of an importin α-like protein and are therefore considered to be non-classical nuclear localization sequences. Another example of a localization sequence is mitochondrial targeting signal, which is a 10 to 70 long peptide that is usually present at the end of nascent proteins and which directs these nascent proteins to the mitochondria. It is usually found at the N-terminus and comprises of an alternating pattern of hydrophobic and positively charged amino acids, thereby usually forming an amphipathic helix. Mitochondrial targeting signals can also contain additional signals that subsequently direct the protein to different regions of the mitochondria, for example the mitochondrial matrix. Like many signal peptides, mitochondrial targeting signals may and are usually cleaved in vivo once targeting is complete. Yet another example of a non-classical nuclear localization protein is a proline tyrosine nuclear localization protein, so named for the presence of a PY-NLS motif, which is a proline-tyrosine amino acid pairing which allows the protein to bind to, for example, importin β2, and thereby facilitating its transport. Therefore, in another example, the localization sequence is a nuclear localization sequence, mitochondrial localization sequence or derivatives thereof. In one example, the mitochondrial localization sequence (MLS) is, but is not limited to, ATP5B, SOD2, COX8A, OTC, or TFAM. In another example, the mitochondrial localization sequence (MLS) is, but is not limited to, SEQ ID NO: 7, SEQ ID NO: 8, SEQ ID NO: 9, SEQ ID NO: 10 or SEQ ID NO: 11.

Thus, in one example, the construct as disclosed herein further comprises at least one localization sequence. In another example, the construct as disclosed herein comprises one or more localization sequences.

In terms of artificially generated fusion proteins, it is possible to attach various modifications, such as, for example, localization sequences, binding tags, selectable markers, optical markers and the like, to either the N-terminus, the C-terminus or both the N- and C-termini of a fusion peptide. This is possible even if in nature, for example, localization signals are usually found at the N-termini of proteins, as these are generally added towards the end of protein translation/expression. Therefore, the presently claimed construct can have one or more of said modifications at each terminus of the protein, provided the functionality of the modification is retained. That is, if, example, a localization signal is required to work in a biological setting in vitro, for example in protein overexpression, then the localization protein needs to be at the N-terminus of the protein, in accordance to its usual position in nature. The same can be said of other modifications, for example binding tags. Thus, in one example, the binding tag is located at either the N-terminus or the C-terminus of the construct, or at both ends of the construct. In another example, the binding tag is located at the N-terminus of the construct.

Protein or binding tags are peptide sequences which can be genetically added to the sequence of a recombinant protein prior to expression. Often, these tags are removable, and are intended to be so, by for example chemical agents or by enzymatic means, such as proteolysis or intein splicing, or by changing the physic-chemical environment of the protein, such as changing the pH value, certain solute concentrations in solution or a change of aqueous to non-aqueous solution. Binding tags are attached to proteins for various purposes, for example, but not limited to, purification via affinity, chromatographic purification, solubilization, detection (optical, immunological or otherwise), protein binding assays or to allow certain modifications of the protein, for example enzymatic modifications, or chemical modifications. Such binding tags may also be attached as multiples to the terminus of the protein in question, for example a single His-tag (HIS) may also be used as a triple His-tag (3×HIS) or a sextuple His-tag (6×HIS). Thus, in one example, the construct as described herein comprises a binding tag. In another example, the binding tag is, but is not limited to, a V5 epitope tag, a FLAG tag, a tandem FLAG-tag, a triple FLAG tag (3×FLAG), a Human influenza hemagglutinin (HA) tag, a tandem HA tag, a triple HA tag (3×HA), a sextuple Histidine tag (6×HIS), biotin, c-MYC, a Glutathione-S-transferase (GST) tag, a Strep-tag, a Strep-tag II, an S-tag (a peptide derived from pancreatic ribonuclease A (RNase A)), a natural histidine affinity tag (HAT), a Calmodulin-binding peptide (CBP) tag, a Streptavidin-binding peptide (SBP) tag, a Chitin-binding domain, a Maltose-binding protein (MBP) or derivatives thereof. In one example, the construct comprises a V5 epitope tag. In another example, the V5 epitope tag sequence is SEQ ID NO: 12 or derivatives thereof.

In one example, the construct, as disclosed herein, includes a self-cleaving peptide. Self-cleaving peptides, first discovered in picornaviruses, are peptides of between 19 to 22 amino acids in length and are usually found between two proteins in some members of the picornavirus family. Using self-cleaving proteins, picornaviruses are capable of producing equimolar levels of multiple genes from the same mRNA. Having said that, such self-cleaving proteins are known to be found in other species of viruses and a person skilled in the art, based on the information provided herein, will be readily able to determine a suitable substitution for the self-cleaving protein disclosed herein, if required. The term "self-cleaving", as used in the art, is not entirely accurate, as, without being bound by theory, these self-cleaving peptides are thought to function by inducing the ribosome to skip the synthesis of a peptide bond at the C-terminus of a 2A element, leading to separation between, for example, the end of the 2A sequence and the next peptide downstream. The "cleavage" of the peptide occurs between the glycine and proline residues found on the C-terminus of the resulting peptide, meaning the upstream cistron will have a few additional residues added to the end, while the downstream cistron will start with the proline residue. Thus, in one example, the construct as described herein comprises a self-cleaving peptide. In another example, the self-cleaving peptide is, but is not limited to, a 2A self-cleaving peptide. In another example, the 2A self-cleaving peptide is SEQ ID NO: 13 or derivative thereof.

As used herein, the term "selectable marker" refers to a marker that can be added to the peptide in question for selection purposes. The type of detection required would then dictate the type of marker that may be used. Thus, in one example, the construct as described herein comprises a selectable marker. In another example, the selectable marker is, but is not limited to, an imaging marker, a cell-surface marker, an antibiotic, an antibiotic resistance marker or derivatives thereof.

For example, if it is required to optically select the peptide in question, one choses an optical marker or an imaging marker, that is a marker that is capable of optical detection. Examples of such an optical or imaging marker are, but are not limited to, green fluorescent protein (GFP), enhanced green fluorescent protein (eGFP), superfold green fluorescent protein, red fluorescent protein (RFP), mCherry, orange fluorescent protein (OFP), cyan fluorescent protein (CFP), enhanced cyan fluorescent protein (eCFP), Cerulean, enhanced blue fluorescent protein (eBFP), yellow fluorescent protein (YFP), enhanced yellow fluorescent protein (eYFP), Venus, far-red fluorescent protein or derivatives thereof. If selection via, for example, resistance to a certain compound is required, an antibiotic resistant marker can be included in the peptide. Examples of such an antibiotic resistant marker are, but are not limited to, a drug-resistant cassette for puromycin, a drug-resistant cassette for blasticidin, a drug-resistant cassette for zeocin, a drug-resistant cassette for G418, a drug-resistant cassette for hygromycin B, a drug-resistant cassette for ampicillin, a drug-resistant cassette for kanamycin, a drug-resistant cassette for chloramphenicol, and derivatives thereof. Such selection markers are usually added to the genetic sequence for the protein in question and are therefore expressed concurrently when the protein is expressed.

A cell-surface marker is a protein that is usually found on the surface of the cell, which can be used to characterize a cell type and/or differentiate between different cell (sub) types. Such cell-surface markers can also include glycoproteins. One example of cell-surface markers are proteins that are named after the so-called cluster of differentiation. This cluster of differentiation is used to catalogue the various epitopes (hence, proteins) present on a cells surface, which are used as targets for, for example, monoclonal antibodies. The epitopes are then numbered and named "CDX", with the "X" denoting a running catalogue number. Therefore, it is possible to positively identify a various cell types using one or more CD markers. In one example, the cell-surface marker is, but is not limited to, CD3, CD4, CD8, CD11a, CD11b, CD14, CD15, CD16, CD19, CD20, CD22, CD24, CD25, CD30, CD31, CD34, CD38, CD56, CD61, CD91, CD117, CD45, CD114, CD182, Foxp3 or derivatives thereof.

The present disclosure describes constructs, the general formula of which is according to formula I as shown below:

[Formula I]

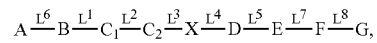

$$A \xrightarrow{L^6} B \xrightarrow{L^1} C_1 \xrightarrow{L^2} C_2 \xrightarrow{L^3} X \xrightarrow{L^4} D \xrightarrow{L^5} E \xrightarrow{L^7} F \xrightarrow{L^8} G,$$

wherein the alphabets denote positions within the peptide sequence. In one example, A is absent, or is a mutated hormone binding domain of the estrogen receptor (ERT2), or the binding tag. In another example, B is the localization sequence, or derivatives thereof, or the binding tag, or absent. In another example, $C_1$ and $C_2$ are each independently any one of the localization sequences or derivatives thereof, or the mutated hormone binding domains of the estrogen receptor (ERT2). In yet another example, in the event that $C_1$ is one mutated hormone binding domain of the estrogen receptor (ERT2), then $C_2$ is another mutated hormone binding domain of the estrogen receptor (ERT2). In another example, $C_2$ is absent. In a further example, X is CRISPR-associated endonuclease or a derivative thereof. In yet another example, D is a mutated hormone binding domain of the estrogen receptor (ERT2), or the localization sequences or derivatives thereof. In one example, E is absent or is a mutated hormone binding domain of the estrogen receptor (ERT2), or the self-cleaving peptide. In another example, F is absent or is the self-cleaving peptide, or the selectable marker. In yet another example, G is absent or is the selectable marker.

In the above structure, the terms $L^1$ to $L^8$ denote linker sequences between the positions within the peptide sequence. In one example, any of the linker sequences $L^1$, $L^2$, $L^3$, $L^4$, $L^5$, $L^6$, $L^7$ or $L^8$ are absent. In another example, one or more of the linker sequences $L^1$, $L^2$, $L^3$, $L^4$, $L^5$, $L^6$, $L^7$ or $L^8$ are absent. In yet another example, the linker sequences are between 1 to 5, between 4 to 8, between 5 to 10, between 10 to 20, between 20 to 25 or 0, 2, 3, 4, 5, 6, 7, 8, 9, 10, 11, 12, 13, 14, 15, 16, 17, 18, 19 or 20 amino acids in length.

A peptide can comprise natural amino acids, unnatural amino acids, or a combination of both unnatural and natural amino acids. As used herein, the term "natural amino acid" refers to proteinogenic amino acids, which are amino acids that are precursors to proteins. These amino acids are assembled during translation to result in a nascent protein. Presently, there are 23 proteinogenic amino acids known, 20 of which are found in the standard genetic code, along with an additional 3 amino acids (selenocysteine, pyrrolysine and N-formylmethionine) that can be incorporated into the peptide using special translation mechanisms. Humans are capable of synthesizing 12 of these from each other or from other molecules of intermediary metabolism. The other nine must be consumed (usually as their protein derivatives), and so they are called essential amino acids. The essential amino acids are histidine, isoleucine, leucine, lysine, methionine, phenylalanine, threonine, tryptophan, and valine (i.e. H, I, L, K, M, F, T, W, V). Unnatural, that is non-proteinogenic amino acids, are amino acids that are not naturally encoded or that are not found in the genetic code of any organisms. These unnatural amino acids, however, can be found in, for example, as intermediates in biosynthesis, post-translationally incorporated into protein, as components of, for example bacterial cell walls, neurotransmitters and toxins, and for example in natural and man-made pharmacological compounds. Thus, in one example, the linker sequences comprise natural or unnatural amino acids, or combinations of both. In another example, one or more, or all of the linker sequences comprise the amino acids A, E, G, P, S and T. In yet another example, one or more, or all of the linker sequences consist of the amino acids A, E, G, P, S and T. In one example, in the event that the linker sequence is absent, the neighbouring substituents then are bound by a peptide bond. In another example, the linker sequence $L^1$ is any one of PR, TG, TGPGPGGS (SEQ ID NO: 370), TGPGPGGSAGDTTGPGTGPG (SEQ ID NO: 371) or TGGGS (SEQ ID NO: 372). In another example, the linker sequence $L^2$ is absent or, independently, any one of PRGGS (SEQ ID NO: 373), GGSPRGGS (SEQ ID NO: 374), PR, or TPGGPRGGS (SEQ ID NO: 375). In another example, the linker sequence $L^3$ is any one of PG, SGSEGA (SEQ ID NO: 376), GASGSKTPG (SEQ ID NO: 377), SGSETPGTSESAGA (SEQ ID NO: 378), SGSETPGTGPGGA (SEQ ID NO: 379), SESATPESGA (SEQ ID NO: 380), GTSESATPESGGA (SEQ ID NO: 381), GGSGGSGA (SEQ ID NO: 382), GA, GGGS (SEQ ID NO: 383), TPESGA (SEQ ID NO: 384), SGSETPGTGA (SEQ ID NO: 385), SGSETPGTSEGA (SEQ ID NO: 386), PAG, PAGGGS (SEQ ID NO: 387), SGSETPGTPGGA (SEQ ID NO: 388), TPESGPGGA (SEQ ID NO: 389) or GASGS (SEQ ID NO: 390). In yet another example, the linker sequence $L^4$ is GGGS (SEQ ID NO: 383) or absent. In a further example, the linker sequence $L^5$ is any one of PAG or PAGGGS (SEQ ID NO: 387). In yet another example, the linker sequence $L^6$ is GA or absent.

In the present disclosure, the terms polypeptide, peptide, and protein are used interchangeably. As used herein, the term "peptide" thus refers to a chain of amino acids which are connected via amide bonds. When the amino acids are alpha-amino acids, either the L-optical isomer or the D-optical isomer can be used, the L-isomers being preferred in nature. The term polypeptide or protein as used herein encompasses any amino acid sequence and includes, but may not be limited to, modified sequences such as glycoproteins. The term polypeptide is specifically intended to cover naturally occurring proteins, as well as those that are recombinantly or synthetically produced.

In one example, the structure is according to formula I, wherein A is absent or is a mutated hormone binding domain of the estrogen receptor (ERT2), or the binding tag; wherein B is the localization sequence or derivatives thereof, or the binding tag, or absent; wherein $C_1$ and $C_2$ are each independently any one of the localization sequences or derivatives thereof, or the mutated hormone binding domains of the estrogen receptor (ERT2); wherein when $C_1$ is one mutated hormone binding domain of the estrogen receptor (ERT2), $C_2$ is another mutated hormone binding domain of the estrogen receptor (ERT2); or wherein $C_2$ is absent; wherein X is CRISPR-associated endonuclease or a derivative thereof, wherein D is a mutated hormone binding domain of the estrogen receptor (ERT2), or the localization sequence or derivatives thereof, wherein E is absent or is a mutated hormone binding domain of the estrogen receptor (ERT2), or the self-cleaving peptide; wherein F is absent or is the self-cleaving peptide, or the selectable marker; wherein G is absent or is the selectable marker; wherein $L^1$, $L^2$, $L^3$, $L^4$, $L^5$, $L^6$, $L^7$ and $L^8$ are linker sequences; wherein any of the linkers $L^1$, $L^2$, $L^3$, $L^4$, $L^5$, $L^6$, $L^7$ or $L^8$ are absent; wherein the linkers sequences are between 1 to 5, between 4 to 8, between 5 to 10, between 10 to 20, between 20 to 25 or 0, 2, 3, 4, 5, 6, 7, 8, 9, 10, 11, 12, 13, 14, 15, 16, 17, 18, 19 or 20 amino acids long; wherein the linker sequences comprise the natural or unnatural amino acids; wherein the linker sequences comprise the amino acids A, E, G, P, S and T; wherein the linker sequences consist of the amino acids A, E, G, P, S and T; wherein if undefined, the linker sequence is absent, the neighbouring substituents are bound by a peptide bond; wherein $L^1$ is any one of PR, TG, TGPGPGGS (SEQ ID NO: 370), TGPGPGGSAGDTTGPGTGPG (SEQ ID NO: 371) or TGGGS (SEQ ID NO: 372); wherein $L^2$ is absent or any one of PRGGS (SEQ ID NO: 373), GGSPRGGS (SEQ ID NO: 374), PR, or TPGGPRGGS (SEQ ID NO: 375); wherein $L^3$ is any one of PG, SGSEGA (SEQ ID NO: 376), GASGSKTPG (SEQ ID NO: 377), SGSETPGTSESAGA (SEQ ID NO: 378), SGSETPGTGPGGA (SEQ ID NO: 379), SESATPESGA (SEQ ID NO: 380), GTSESATPESGGA (SEQ ID NO: 381), GGSGGSGA (SEQ ID NO: 382), GA, GGGS (SEQ ID NO: 383), TPESGA (SEQ ID NO: 384), SGSETPGTGA (SEQ ID NO: 385), SGSETPGTSEGA (SEQ ID NO: 386), PAG, PAGGGS (SEQ ID NO: 387), SGSETPGTPGGA (SEQ ID NO: 388), TPESGPGGA (SEQ ID NO: 389) or GASGS (SEQ ID NO: 390); wherein $L^4$ is GGGS (SEQ ID NO: 383) or absent; wherein $L^5$ is any one of PAG or PAGGGS (SEQ ID NO: 387); wherein $L^6$ is GA or absent, wherein $L^7$ and $L^8$ are independently selected from the linkers as disclosed in any of $L^1$ to $L^6$. In one example, A is absent. In another example, A is a mutated hormone binding domain of the estrogen receptor (ERT2). In yet another example, A is a binding tag.

In one example, B is the binding tag. In another example, B is a localization sequence.

In one example, $C_1$ is the localization sequence. In another example, $C_1$ is the mutated hormone binding domain of the estrogen receptor (ERT2).

In one example, $C_2$ is absent.

In one example, D is the localization sequence. In another example, D is a mutated hormone binding domain of the estrogen receptor (ERT2).

In one example, E is the self-cleaving peptide. In another example, E is the mutated hormone binding domain of the estrogen receptor (ERT2). In yet another example, E is absent.

In one example, F is the selectable marker. In another example, F is the self-cleaving peptide.

In one example, G is absent. In another example, G is the selectable marker.

In one example, X is the CRISPR-associated endonuclease or derivative thereof.

In a further example, A is absent, B is the binding tag, $C_1$ is the localization sequence and $C_2$ is absent. In yet another example, A is the mutated hormone binding domain of the estrogen receptor (ERT2), B is the binding tag, $C_1$ is the localization sequence and $C_2$ is absent. In a further example, A is the binding tag, B is the localization sequence, $C_1$ is the mutated hormone binding domain of the estrogen receptor (ERT2) and $C_2$ is absent. In yet another example, wherein D is the localization sequence, E is the self-cleaving peptide, F is the selectable marker and G is absent. In a further example, D is the localization sequence, E is the mutated hormone binding domain of the estrogen receptor (ERT2), F is the self-cleaving peptide and G is the selectable marker. In one example, D and E are each one mutated hormone binding domain of the estrogen receptor (ERT2). In another example, D is the mutated hormone binding domain of the estrogen receptor (ERT2) and E is absent. In yet another example, A is the mutated hormone binding domain of the estrogen receptor (ERT2), B is the binding tag, $C_1$ is the localization sequence and $C_2$ is absent, X is the CRISPR-associated endonuclease or derivative thereof, D is the localization sequence, E is the self-cleaving peptide, F is the selectable marker and G is absent. In a further example, A is the binding tag, B is the localization sequence, $C_1$ is the mutated hormone binding domain of the estrogen receptor (ERT2) and $C_2$ is absent, X is the CRISPR-associated endonuclease or derivative thereof, D is the localization sequence, E is the self-cleaving peptide, F is the selectable marker and G is absent. In yet another example, A is absent, B is the binding tag, $C_1$ is the localization sequence and $C_2$ is absent, X is the CRISPR-associated endonuclease or derivative thereof, D is the localization sequence, E is the mutated hormone binding domain of the estrogen receptor (ERT2), F is the self-cleaving peptide and G is the selectable marker. In one example, A is the mutated hormone binding domain of the estrogen receptor (ERT2), B is the binding tag, $C_1$ is the localization sequence and $C_2$ is absent, X is the CRISPR-associated endonuclease or derivative thereof, D is the localization sequence, E is the mutated hormone binding domain of the estrogen receptor (ERT2), F is the self-cleaving peptide and G is the selectable marker. In another example, A is the binding tag, B is the localization sequence, $C_1$ is the mutated hormone binding domain of the estrogen receptor (ERT2) and $C_2$ is absent, X is the CRISPR-associated endonuclease or derivative thereof, D is the localization sequence, E is the mutated hormone binding domain of the estrogen receptor (ERT2), F is the self-cleaving peptide and G is the selectable marker.

In another example, the construct comprising the following formula (II):

[Formula II]

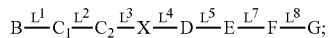

$$B \xrightarrow{L^1} C_1 \xrightarrow{L^2} C_2 \xrightarrow{L^3} X \xrightarrow{L^4} D \xrightarrow{L^5} E \xrightarrow{L^7} F \xrightarrow{L^8} G;$$

wherein A is absent; wherein B is a localization sequence or derivatives thereof, or the binding tag; wherein both $C_1$ and $C_2$ are present or only $C_1$ is present; wherein $C_1$ and $C_2$ are each independently selected from the group consisting of the localization sequence, derivatives thereof of the localization sequence, and a mutated hormone binding domain of the estrogen receptor (ERT2); wherein when $C_1$ is one mutated hormone binding domain of the estrogen receptor (ERT2), $C_2$ is another mutated hormone binding domain of the estrogen receptor (ERT2); wherein X is a CRISPR-associated endonuclease or a derivative thereof, wherein D is selected from the group consisting of a mutated hormone binding domain of the estrogen receptor (ERT2), the localization sequence and derivatives of the localization sequence; wherein E is absent or is selected from the group consisting of a mutated hormone binding domain of the estrogen receptor (ERT2) and a self-cleaving peptide; wherein F is absent or is selected from the group consisting of the self-cleaving peptide, the mutated hormone binding domain of the estrogen receptor (ERT2) and a selectable marker; wherein G is absent or is the selectable marker; wherein $L^1$, $L^2$, $L^3$, $L^4$, $L^5$, $L^6$, L and $L^8$ are linker sequences; wherein at least one of the linker sequences is present; wherein each of the linkers sequences is independently between 1 to 25 amino acids long; wherein each linker sequence independently comprises natural or unnatural or a mixture of natural and unnatural amino acids; wherein the linker sequences comprise the amino acids A, E, G, P, S and T; wherein, if any one or more of the linker sequences of $L^1$ to $L^8$ is absent, the neighbouring substituents are bound by a peptide bond; wherein $L^1$ is selected from the group consisting of PR, TG, TGPGPGGS (SEQ ID NO: 370), TGPGPGGSAGDTTGPGTGPG (SEQ ID NO: 371), TGPGGS (SEQ ID NO: 391), TGPGGSAGDTTGPGGS (SEQ ID NO: 392) and TGGGS; wherein $L^2$ is selected from the group consisting of PRGGS (SEQ ID NO: 373), GGSPRGGS (SEQ ID NO: 374), PR, and TPGGPRGGS (SEQ ID NO: 375); wherein $L^3$ is selected from the group consisting of PG, SGSEGA (SEQ ID NO: 376), GASG-SKTPG (SEQ ID NO: 377), SGSETPGTSESAGA (SEQ ID NO: 378), SGSETPGTGPGGA (SEQ ID NO: 379), SES-ATPESGA (SEQ ID NO: 380), GTSESATPESGGA (SEQ ID NO: 381), GGSGGSGA (SEQ ID NO: 382), GA, GGGS (SEQ ID NO: 383), TPESGA (SEQ ID NO: 384), SGSETPGTGA (SEQ ID NO: 385), SGSETPGTSEGA (SEQ ID NO: 386), PAG, PAGGGS (SEQ ID NO: 387), SGSETPGTPGGA (SEQ ID NO: 388), TPESGPGGA (SEQ ID NO: 389) and GASGS (SEQ ID NO: 390); wherein $L^4$ is GGGS (SEQ ID NO: 383); wherein $L^5$ and $L^7$ are independently PAG, SGS or PAGGGS (SEQ ID NO: 387); wherein $L^6$ is GA; wherein $L^8$ is selected from the linkers as disclosed in any of $L^1$ to $L^6$.

In one example, B is the localization sequence, $C_1$ is the mutated hormone binding domain of the estrogen receptor (ERT2) and $C_2$ is absent. In another example, D is a localization sequence and E and F are each a mutated hormone binding domain of the estrogen receptor (ERT2). In yet another example, A is absent, B is localization sequence, $C_1$ is the mutated hormone binding domain of the estrogen receptor (ERT2), $C_2$ is absent, X is a CRISPR-associated endonuclease or a derivative thereof, D is localization sequence, E is a mutated hormone binding domain of the estrogen receptor (ERT2) and F is absent. In a further example, B is a localization sequence, $C_1$ is the mutated hormone binding domain of the estrogen receptor (ERT2), $C_2$ is absent, X is a CRISPR-associated endonuclease or a derivative thereof, D is localization sequence and E and F are both each a mutated hormone binding domain of the estrogen receptor (ERT2). In another example, B is a localization sequence, $C_1$ and $C_2$ are each independently a mutated hormone binding domain of the estrogen receptor (ERT2), X is a CRISPR-associated endonuclease or a derivative thereof, D is localization sequence and E and F are both each a mutated hormone binding domain of the estrogen receptor (ERT2).

In one example, the construct, as disclosed herein, has at least 50%, 55%, 60%, 65%, 70%, 75%, 80%, 85%, 90%, 95%, 96%, 97%, 98% or 99% sequence identity to any one of SEQ ID NOs: 15 to 74. In another example, the construct, as disclosed herein, has a sequence identity of between 80% to 95% to any one of SEQ ID NOs: 15 to 74. In yet another example, the construct has a sequence identity of at least 90% to any one of SEQ ID NOs: 15 to 74.

As used herein, the term "variant" includes a reference to substantially similar sequences. Generally, nucleic acid sequence variants of the invention encode a polypeptide which retains qualitative biological activity in common with the polypeptide encoded by the "non-variant" nucleic acid sequence. Generally, polypeptide sequence variants of the invention also possess qualitative biological activity in common with the "non-variant" polypeptide. Further, these polypeptide sequence variants may have at least 25%, 30%, 35%, 40%, 45%, 50%, 55%, 60%, 65%, 70%, 75%, 80%, 85%, 90%, 95%, 96%, 97%, 98% or 99% sequence identity to the "non-variant" peptide. Variants may be made using, for example, the methods of protein engineering and site-directed mutagenesis as is well known in the art. Further, a variant peptide or protein may include analogues, wherein the term "analogue", as used herein, with reference to a peptide, means a peptide which is a derivative of a peptide of the invention, whereby the term "derivative" comprises a polypeptide that has addition, deletion, substitution of one or more amino acids compared to the "non-variant" peptide, such that the polypeptide retains substantially the same function as the non-variant peptide. The substitution may be one or more conservative amino acid substitutions. The term "derivative" or "derivation" also refer to compounds other than amino acids, which have been modified from the original compound. In some example, these derivatives retain the same or have increased desired function. In regards to chemical compounds, the term "derivative" refers to a chemical substance derived from another substance, either directly or by modification or partial substitution. In this case, chemical derivatives but do not necessarily retain their original function. The term "conservative amino acid substitution" as used herein refers to a substitution or replacement of one amino acid for another amino acid with similar properties within a peptide chain (primary sequence of a protein). For example, the substitution of the charged amino acid glutamic acid (Glu) for the similarly charged amino acid aspartic acid (Asp) would be a conservative amino acid substitution. Conservative amino acid substitution tables providing functionally similar amino acids are well known to one of ordinary skill in the art. The following six groups are examples of amino acids that are considered to be conservative substitutions for one another:

1) Alanine (A), Serine (S), Threonine (T);
2) Aspartic acid (D), Glutamic acid (E);
3) Asparagine (N), Glutamine (Q);
4) Arginine (R), Lysine (K);
5) Isoleucine (I), Leucine (L), Methionine (M), Valine (V); and
6) Phenylalanine (F), Tyrosine (Y), Tryptophan (W).

A non-conservative amino acid substitution can result from changes in: (a) the structure of the amino acid backbone in the area of the substitution; (b) the charge or hydrophobicity of the amino acid; or (c) the bulk of an amino acid side chain. Substitutions generally expected to produce the greatest changes in protein properties are those in which: (a) a hydrophilic residue is substituted for (or by) a hydrophobic residue; (b) a proline is substituted for (or by) any other residue; (c) a residue having a bulky side chain, e.g., phenylalanine, is substituted for (or by) one not having a side chain, e.g., glycine; or (d) a residue having an electropositive side chain, e.g., lysyl, arginyl, or histadyl, is substituted for (or by) an electronegative residue, e.g., glutamyl or aspartyl.

As used herein, the term "mutation" or grammatical variants thereof, in general, relates to an altered genetic sequence which results in the gene coding for a non-functioning protein, or a protein with substantially reduced, or altered function. The term "mutation" also relates to a modification of the genome or part of a nucleic acid sequence of any biological organism, virus or extra-chromosomal genetic element, or any genetic element that has been included in the nucleic acid sequence of a fusion protein. The mutation can be performed by replacing one nucleotide by another in the nucleic acid sequence of any of the genetic elements, thus creating a different amino acid in the position where the nucleotide was replaced. The techniques in order to achieve such mutations are well known to a person skilled in the art. For example, the mutation can be induced artificially using, but not limited to, chemicals, PCR reactions, and radiation. When artificially created, in the context of the invention, a mutation is by extension, the replacement of an amino acid encoded by a given nucleic acid sequence to another amino acid in a nucleic acid sequence or a genetic element. Thus, the section of the construct, as disclosed herein, containing the full, unchanged sequences for, for example, the hormone binding domain of the estrogen receptor (ERT2), would be considered to contain the wild type hormone binding domain of the estrogen receptor (ERT2), while sections of the construct carrying a mutation in the hormone binding domain of the estrogen receptor (ERT2) are termed mutated hormone binding domain of the estrogen receptor (ERT2).

The present disclosed describes constructs for the expression of fusion proteins having the desired capability of genome engineering, that is genome editing. In order for such fusion proteins to be expressed, the constructs, as disclosed herein, need to be brought into a cell for protein expression. Thus, in one example, a host cell is transfected with the nucleic acid sequence as described herein, thereby resulting in the expression of the desired protein within the cell. In another example, the transfection is done via nucleofection or electroporation. In another example, the present disclosure describes a nucleic acid sequence encoding any one of the constructs as disclosed herein. In yet another example, there is disclosed a vector comprising the nucleic acid sequence of a construct as disclosed herein. In a further example, a host cell comprising the vector as disclosed herein is described. In one example, he host cell is a mammalian cell. In another example, the mammalian cell is, but is not limited to, mouse, horse, sheep, pig, cow, hamster or human. In another example, the host cell is bacterial.

Any or all of the components, as described herein, may be provided in the form of a kit. Thus, in one example, a kit comprising the construct as disclosed herein and an inducing agent is described. In another example, the kit comprises tamoxifen as an inducing agent, and/or a derivative thereof.

Described herein are also methods for using the claimed construct for genome editing. Thus, in one example, there is disclosed a method of editing a genome of a host cell using the construct as disclosed herein, wherein the host cell, comprising the nucleic acid sequence are as defined herein, is incubated with an inducing agent. Also disclosed herein is a method of editing a genome of a host cell using the construct as defined herein, wherein the method comprises transfecting the host cell with the nucleic acid sequence as defined herein; and incubating the cell with an inducing agent. IN another example, the transfection can be done using, for example, nucleofection, or electroporation.

The invention illustratively described herein may suitably be practiced in the absence of any element or elements, limitation or limitations, not specifically disclosed herein. Thus, for example, the terms "comprising", "including", "containing", etc. shall be read expansively and without limitation. Additionally, the terms and expressions employed herein have been used as terms of description and not of limitation, and there is no intention in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments and optional features, modification and variation of the inventions embodied therein herein disclosed may be resorted to by those skilled in the art, and that such modifications and variations are considered to be within the scope of this invention.

The invention has been described broadly and generically herein. Each of the narrower species and sub-generic groupings falling within the generic disclosure also form part of the invention. This includes the generic description of the invention with a proviso or negative limitation removing any subject matter from the genus, regardless of whether or not the excised material is specifically recited herein.

Other embodiments are within the following claims and non-limiting examples. In addition, where features or aspects of the invention are described in terms of Markush groups, those skilled in the art will recognize that the invention is also thereby described in terms of any individual member or subgroup of members of the Markush group.

EXPERIMENTAL SECTION

The CRISPR (clustered regularly interspaced short palindromic repeats)-Cas9 system enables ready modification of the mammalian genome and has been used to generate single or multiplexed gene knockouts, introduce specific point mutations, or insert epitope tags. However, there is a lack of generalizable methods to rapidly control the activity of the Cas9 endonuclease.

Disclosed herein is the development of a Cas9 variant, whose activity can be switched on and off in mammalian cells, for example, human cells, using an inducing agent, for example the chemical tamoxifen. Fusions of the wildtype Cas9 enzyme with the mutated hormone-binding domain of the estrogen receptor (ERT2) were generated. Furthermore, these Cas9 variant were systematically engineered by varying the position of ERT2 relative to Cas9, altering the number of ERT2 copies at the N- or C-terminus of Cas9, and testing different linker lengths and compositions. The optimized Cas9 variant (iCas) shows minimal endonuclease activity in the absence of tamoxifen but exhibits high editing efficiencies at multiple loci when the inducing agent is added. The duration and concentration of the inducing agent, for example tamoxifen, were also tuned so as to eliminate off-target genome modification. Additionally, iCas was utilised to target the Wnt signalling pathway and demonstrated that genome modification and signalling perturbation occurred much more rapidly than an alternative system that relied on a doxycycline-inducible promoter to drive Cas9 expression. The results highlight the utility of iCas for tight spatiotemporal control of genome editing activity.

Initial Development of a Chemical-Inducible Cas9 Variant

Figure 1:
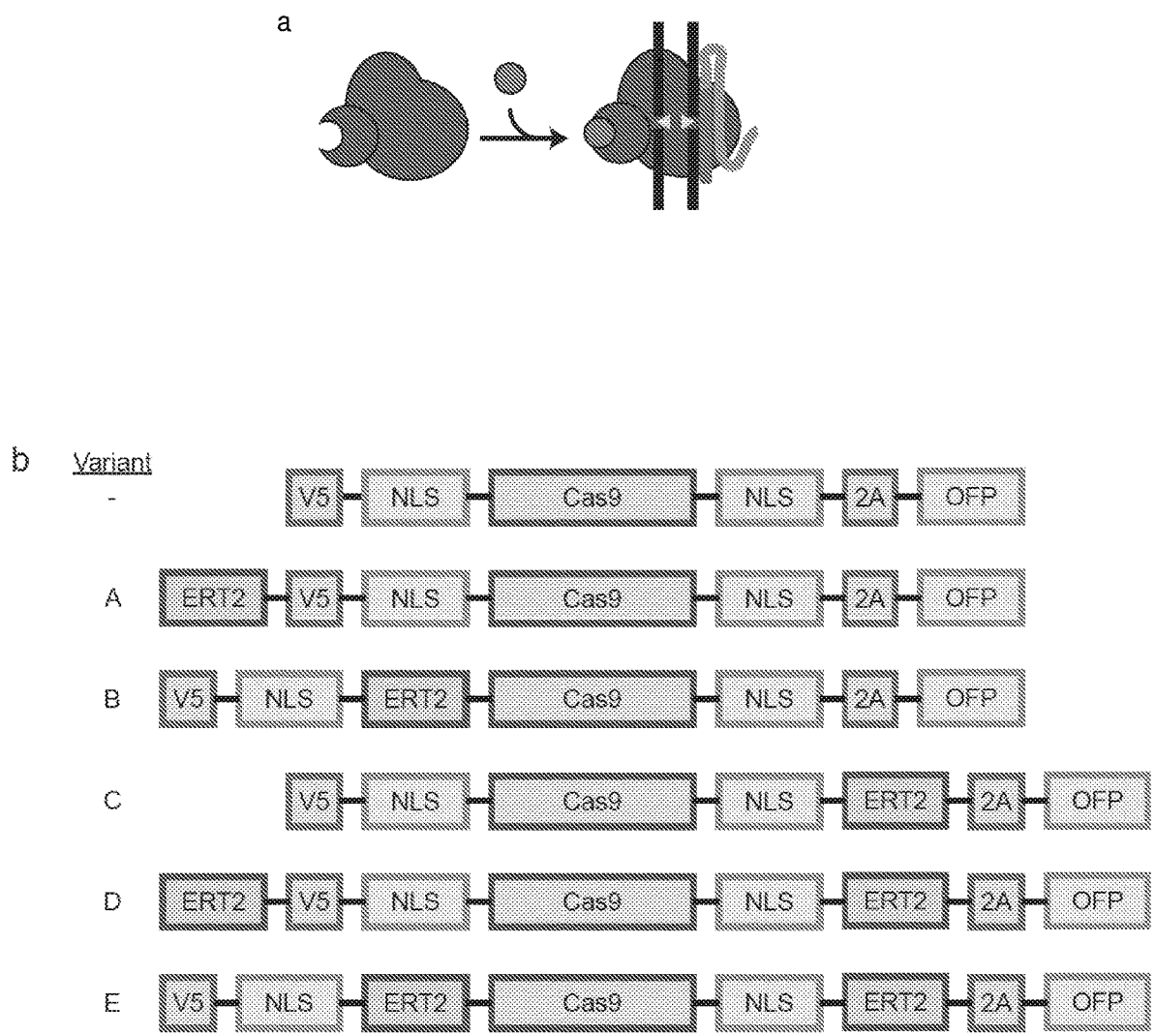
FIG. 1|Building and testing a 4-HT-inducible Cas9. (a) Schematic of the ERT2-based strategy. A fusion of Cas9 (red) and ERT2 (crescent shape) was predicted to be sequestered in the cytoplasm. However, in the presence of an antagonist such as 4-HT (circle), the enzyme could enter the nucleus, form a complex with a sgRNA (brown and green), and generate a double-stranded break (triangles) in the cell's DNA (black). (b) Architectures of different Cas9-ERT2 fusions tested. Top, the original wild-type Cas9 construct, which contains a V5 epitope tag and two NLSs joined to Cas9. The orange fluorescent protein (OFP) is separated from Cas9 by a 2A self-cleaving peptide. Other rows represent five distinct configurations of NLS, ERT2, and Cas9 that were evaluated in this study. (c) Extent of genome modification determined by the Surveyor cleavage assay. Four genomic loci were tested, with each locus evaluated in at least two biological replicates, giving a total of eight independent experiments. Boxplots indicate the range of INDELs obtained from all the experiments. Wild-type Cas9 generated robust DNA modifications at all the targeted loci with or without 4-HT. In contrast, variant E, an ERT2-Cas9-ERT2 fusion, exhibited low activity in the absence of 4-HT but significantly higher activity in the presence of the chemical ($P<0.05$, Student's t-test). (d) Extent of genome modification determined by Illumina deep sequencing. Wildtype Cas9 exhibited robust genome editing activity independent of tamoxifen. Consistent with the results from the Surveyor assay, fusion of the ERT2 domain to both the N-terminus and C-terminus of Cas9 could render the endonuclease activity of the enzyme to be significantly dependent on tamoxifen ( $P<0.05$, Student's t-test).
Figure 1:
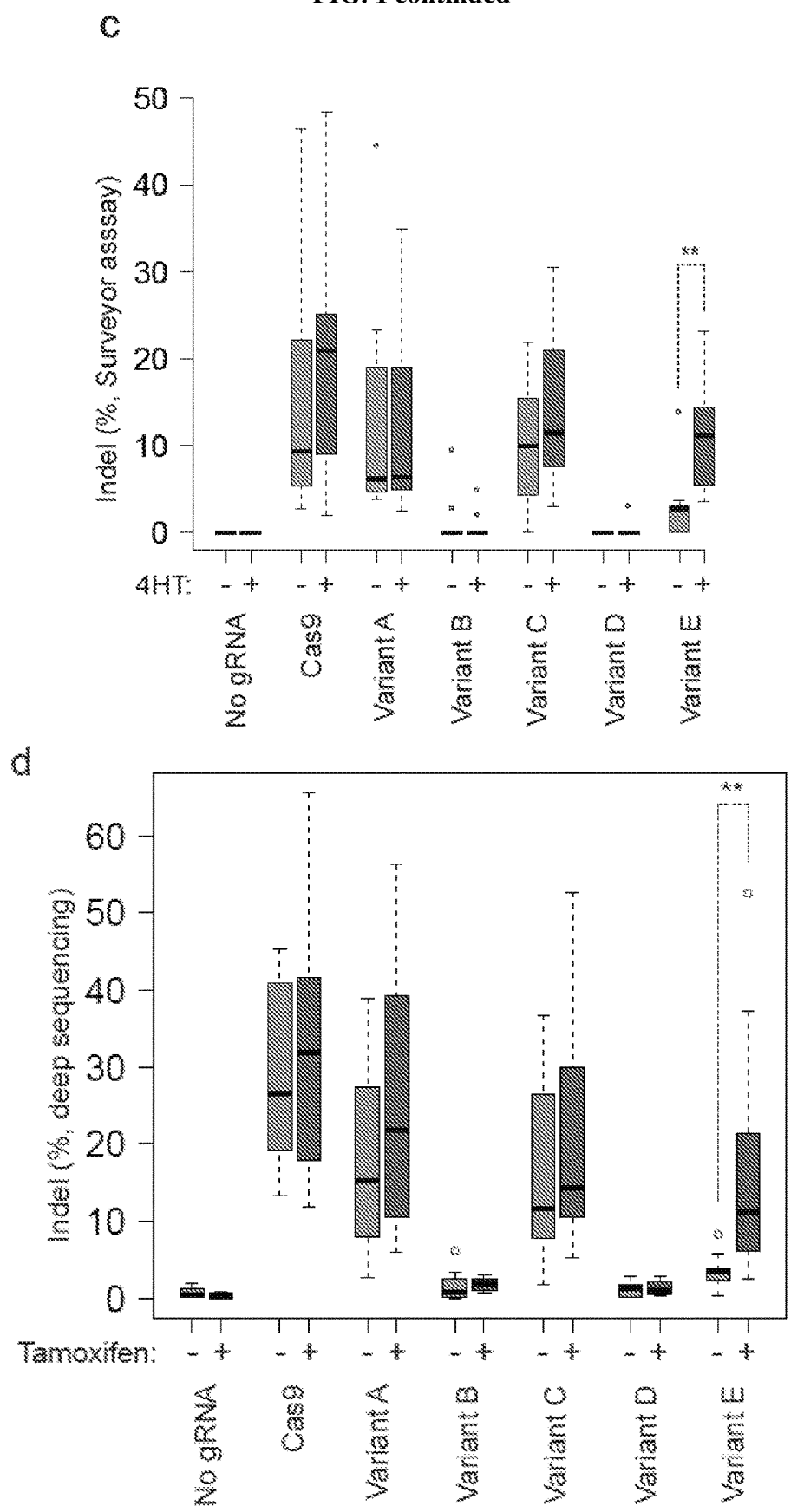
Figure 5:
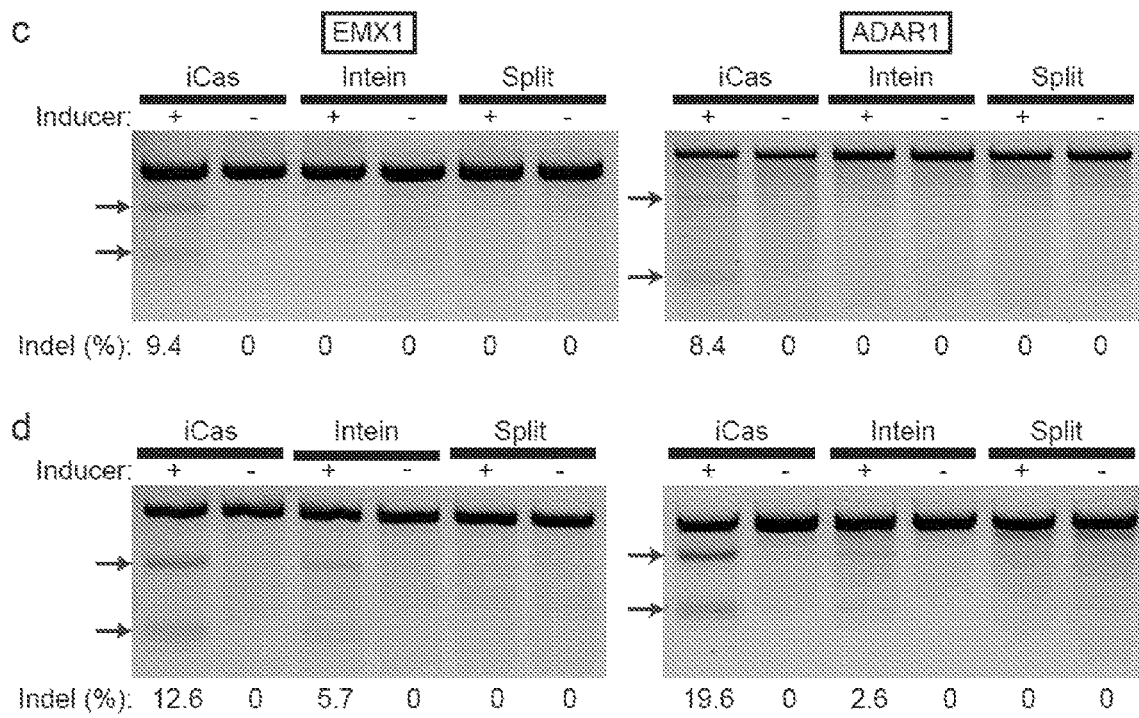
FIG. 5|Comparison of iCas with intein-Cas9 and split-Cas9. (a) Detection of genome modification at the EMX1 locus by Surveyor cleavage assay. Transfected HEK293 cells were treated with (+, solid lines) or without (−, dashed lines) chemical inducer and harvested at 12, 24, 48, 72, or 96 h after treatment. Data represent mean±s.e.m. of 4 (12, 24, 48, and 96 h) or 8 (72 h) biological replicates. (b) Switching ratios at the EMX1 locus upon addition of inducer. *$P<0.1$, **$P<0.05$, Student's t-test. Center lines, median; box limits, interquartile range; whiskers, 1.5× interquartile range. (c,d) Surveyor cleavage assay evaluating the ability of iCas, intein-Cas9, and split-Cas9 to edit two genomic loci simultaneously after 12 (c) or 24 h (d) of inducer treatment. Arrows indicate the expected cleavage bands. (Full gel images are shown in FIG. 29.)
Figure 6:
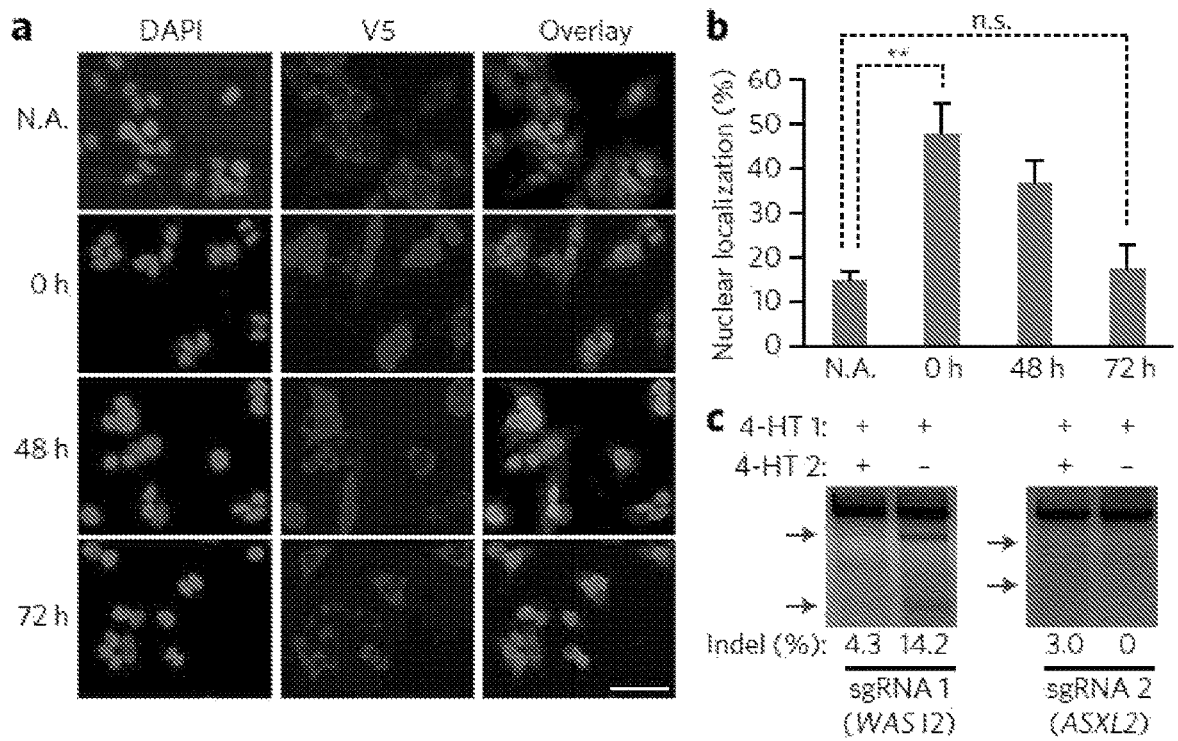
FIG. 6|Toggling the activity of iCas on and off (a,b) Immunofluorescence images (a) and quantification (b) of iCas in HEK293-iCas cells either untreated (N.A.) or treated with 4-HT and then fixed at 0, 48, or 72 h after removal of 4-HT from the culture medium. DAPI, nuclear staining; V5, antibody specific for V5-tagged Cas9. Scale bar, 50 m. In (b), at least 300 cells were counted for each sample and time point. Data represent mean±s.d. from three biological replicates. n.s., not significant ($P>0.25$); **$P<0.001$, Student's t-test. (c) Surveyor assay detection of genome modification in HEK293 cells after two cycles of transfection and 4-HT treatment (4-HT 1 and 4-HT 2). A sgRNA targeting the WAS locus was transfected first, and a sgRNA targeting the ASXL2 locus second. Arrows indicate the expected cleavage bands. (The full gel image is shown in FIG. 30.)

Different fusions of the ERT2 domain with wildtype Cas9 derived from the bacterium *Streptococcus pyogenes* (FIG. 1b) were constructed and tested. ERT2 was placed at either the N- or C-terminus of Cas9 and the position of the nuclear localization signal (NLS) was also varied. Using HEK293 cells, the constructs were evaluated for editing activity with and without 1 µM 4-hydroxytamoxifen (4HT) by targeting four distinct genomic loci—a coding exon of the EMX1 gene, an intron of PPP1R12C gene, and two separate sites within the promoter region of the VEGFA gene. As determined using the Surveyor cleavage assay, which provides an estimation of the amount of genome modifications present, it was found that only variant E, an ERT2-Cas9-ERT2 fusion, showed low editing activity in the absence of 4HT, but significantly higher editing when the chemical was present (P<0.05, Student's t-test) across all four targeted loci (FIG. 1c). Illumina deep sequencing technology was also used to quantify the percentage of insertions and deletions (INDELS) generated at the targeted sites by each construct and observed that addition of tamoxifen significantly increased the editing activity of variant E at all the targeted loci (P<0.05, Student's t-test), but did not have a consistent effect on the other variants tested (FIG. 1d). The results were further confirmed by Sanger sequencing of individual clones (FIG. 5). The difference in genome editing activity with and without tamoxifen was not due to a change in overall Cas9 protein levels, but was rather a result of a dramatic change in the amount of Cas9 present in the nucleus (FIG. 6). Taken together, these results indicate that the fusion of ERT2 domains to both the N- and C-terminus of Cas9 rendered the endonuclease activity of Cas9 dependent on tamoxifen by sequestering the enzyme in the cytoplasm in the absence of the inducer; upon addition of tamoxifen, the ERT2-Cas9-ERT2 fusion protein was able to translocate into the nucleus to perform its genome editing function.

Optimization of the ERT2-Cas9-ERT2 Architecture

All the initial fusion variants tested showed some background activity without tamoxifen, especially at the EMX1 exonic site and one of the VEGFA promoter sites. Hence, it was sought to develop the conditional genome editing system further. First, the lengths and amino acid compositions of the protein linkers between each ERT2 domain and the Cas9 enzyme were varied. Linker lengths that were tested ranged from 2 to 20 amino acids and the main focus was on the linker composition primarily of six amino acids (A, E, G, P, S, and T), which had previously been reported to be ideal for generating open flexible loops, and therefore polypeptides in stable conformations. Second, since the size of Cas9 is around four times that of Cre (160 kDa versus 40 kDa), it was reasoned that more copies of the ERT2 domain may be required to fully control the cellular localization and subsequent activity of the Cas9 nuclease. Thus, different copy numbers of ERT2 at either the N- or C-terminus of Cas9 were tested. In total, 30 variants with distinct configurations (FIG. 2a and Table 1) were further analysed. The variants were classified into four separate groups based on how they differed from the initial ERT2-Cas9-ERT2 fusion.

Figure 2:
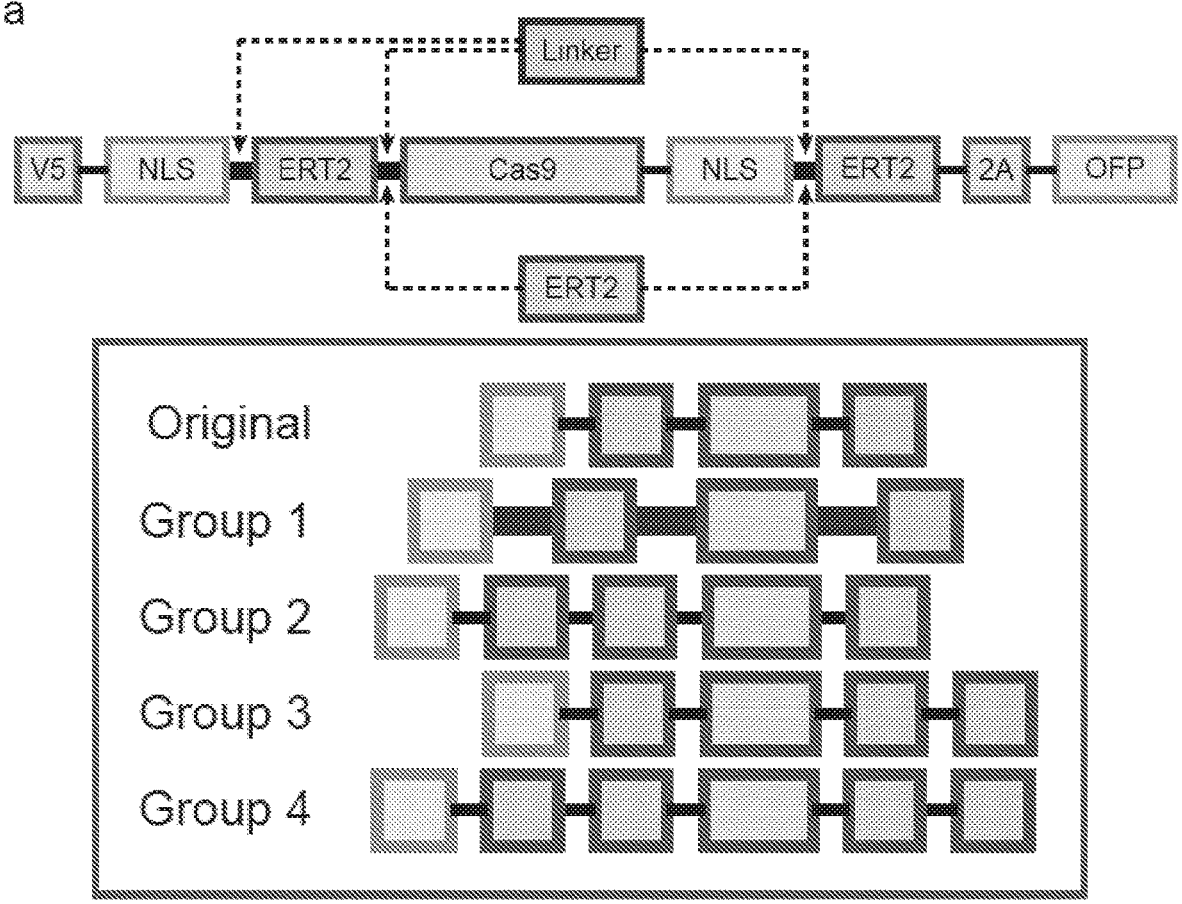
FIG. 2|Optimization of the ERT2-Cas9-ERT2 architecture. (a) Left, placement of linkers and ERT2 copies evaluated in this study. Right, grouping of the 30 Cas9 variants tested on the basis of how they differ from the original variant E (see Supplementary Table 1 for details). OFP, orange fluorescent protein; 2A, self-cleaving peptide. (b) GFP disruption activity of the 30 Cas9 variants, wild-type Cas9, and the original variant E in the absence or presence of 4-HT. Boxes represent the range of values achieved by every variant within a particular group. Center lines, median; box limits, interquartile range; whiskers, 1.5× interquartile range. Each construct was tested in at least six biological replicates. n.s., not significant ($P>0.25$, Wilcoxon rank-sum test). (c) Detection of genome modification by Surveyor assay. Target site DNA was amplified from cells transfected with wild-type Cas9 or a Cas9 variant and treated with or without 4-HT (n=2 biological replicates per construct). n.s., not significant ($P>0.25$, Wilcoxon rank-sum test). (d) GPF reduction and INDEL percentages for the best-performing Cas9 variants. Each variant contained four copies of ERT2 and showed 4-HT-dependent activity, as assessed by GFP disruption assay (top), Surveyor assay (middle), and deep sequencing experiments (bottom). Transfection of wild-type Cas9 without and with the appropriate sgRNA served as negative and positive control, respectively.
Figure 2:
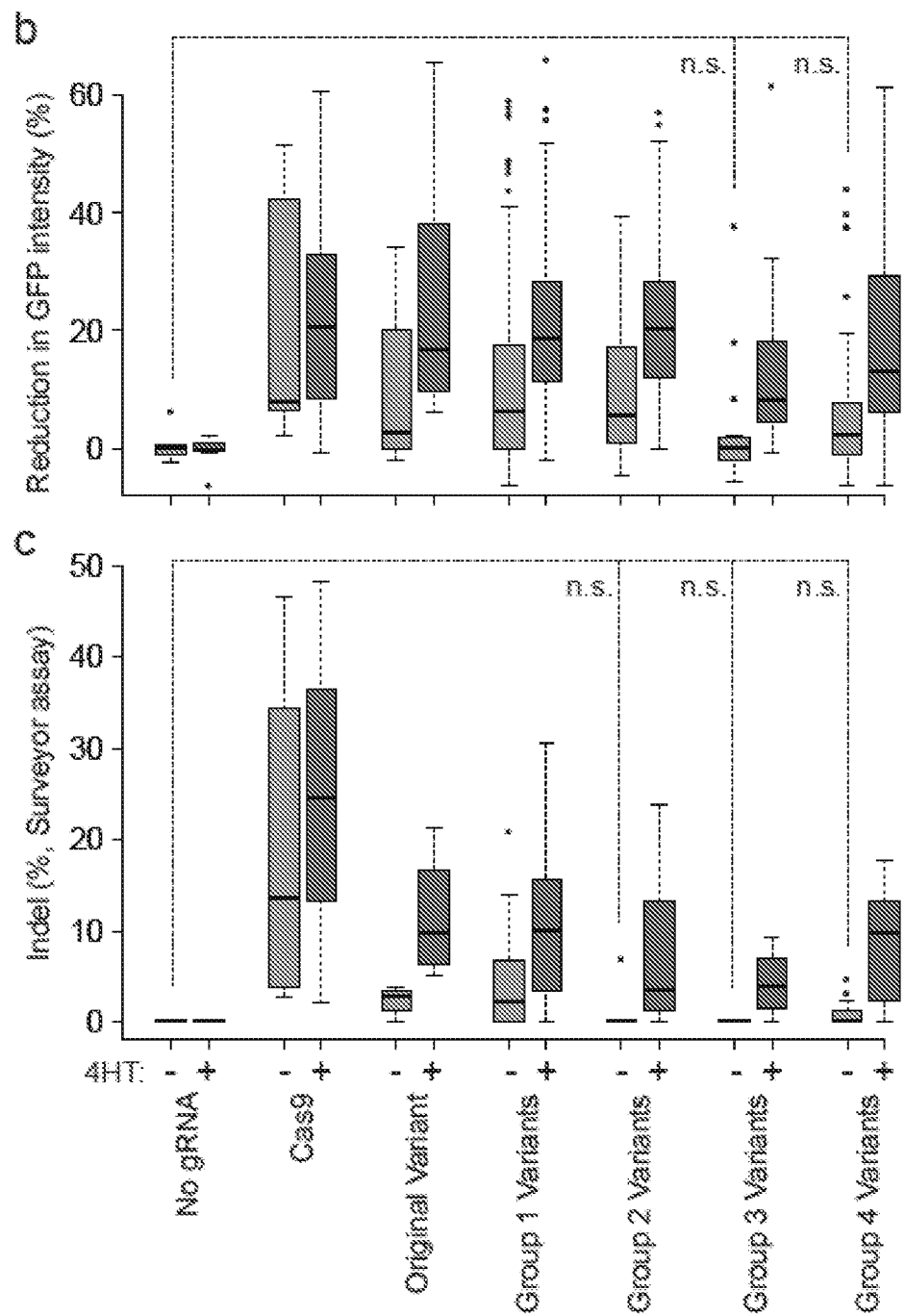
Figure 2:
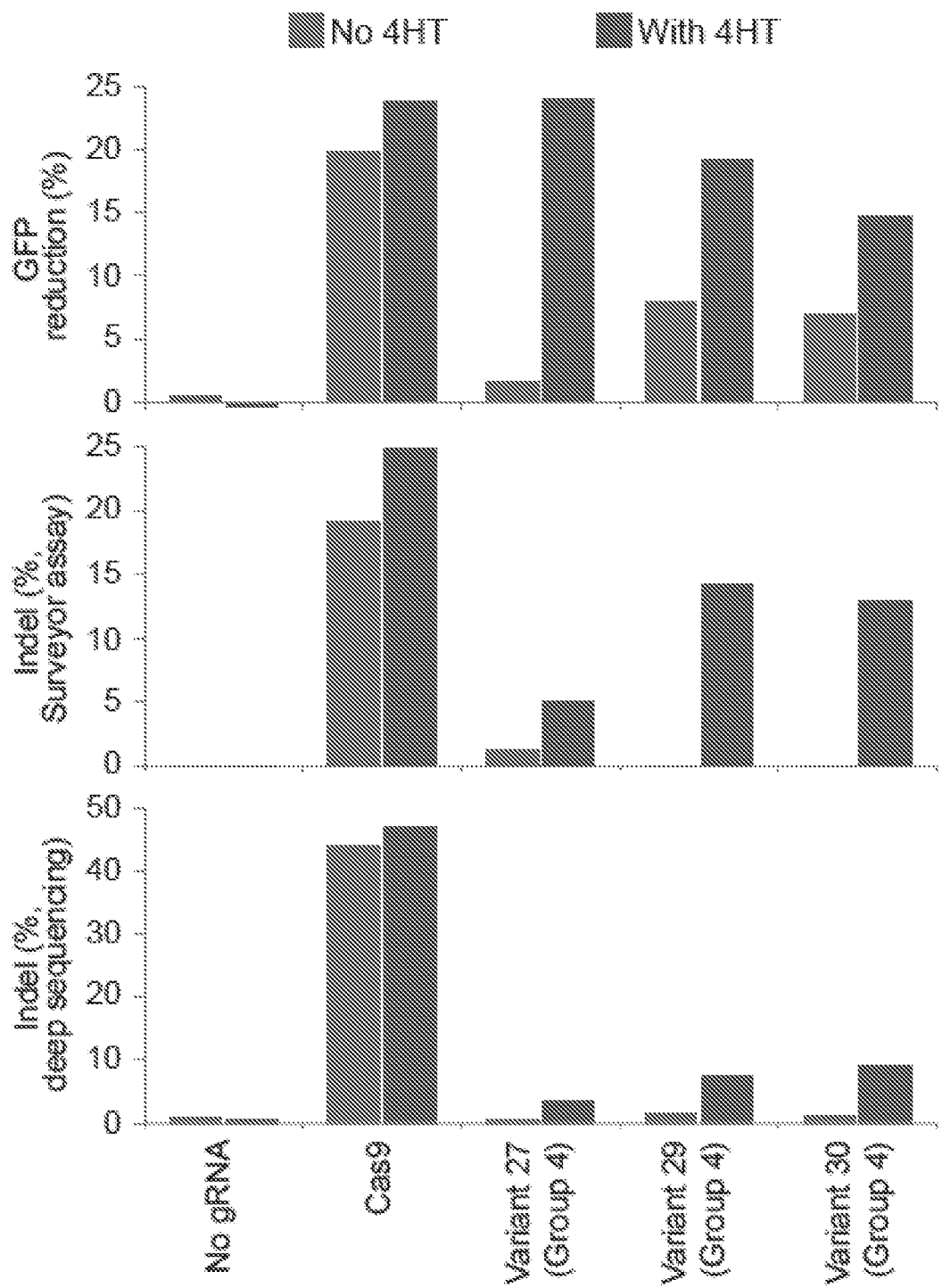
Figure 7:
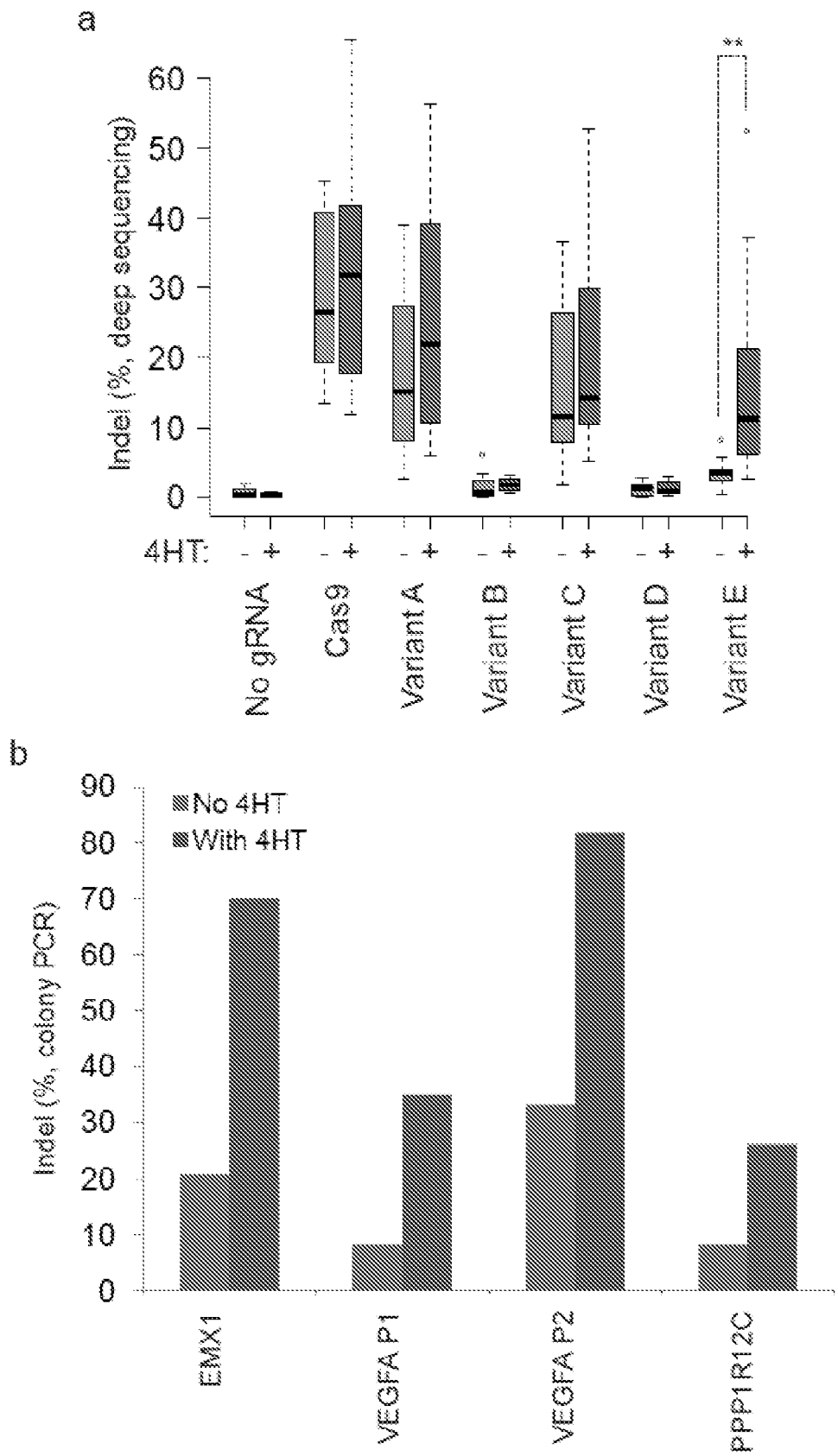
FIG. 7|Assessing the feasibility of an ERT2-based strategy to control the activity of Cas9. (a) Illumina deep sequencing was used to quantify the percentage of insertions and deletions (indels) generated at four targeted sites (n=2 biological replicates for each locus). Wildtype Cas9 exhibited robust genome editing activity independent of 4HT. In contrast, fusion of the ERT2 domain to both the N-terminus and C-terminus of Cas9 (variant E) rendered the endonuclease activity of the enzyme to be significantly dependent on 4HT (** $P<0.05$, Student's t-test). (b) The genome editing activity of variant E was evaluated with and without 1 μM 4HT by clonal Sanger sequencing (one replicate).

To assay the activities of all the Cas9 variants, a green fluorescent protein (GFP) disruption assay was employed, whereby cleavage and erroneous repair of a constitutively expressed GFP gene in HEK293 cells causes a loss of fluorescence signal which can be detected by flow cytometry (FIG. 7). Two different sgRNAs were used to target non-overlapping regions of the GFP gene. For comparison, the original ERT2-Cas9-ERT2 fusion (variant E) and the wildtype Cas9 enzyme were included, which provided an estimation of the maximum possible reduction in fluorescence signal. It was observed that cells transfected with the wildtype Cas9 enzyme showed a high reduction in GFP intensity regardless of whether 4-hydroxytamoxifen was present or absent (FIG. 2b). In contrast, all the tested variants exhibited an increased reduction of fluorescence signal upon 24 hours of 4-hydroxytamoxifen treatment. It was also observed that most of the variants showed some loss of fluorescence signal, even without the presence of tamoxifen, suggesting activity leakage. The variants that showed the least leakage belonged to Group 3 and Group 4, which contained two copies of ERT2 on the C-terminus of Cas9.

To confirm the results of the GFP disruption experiments, the T7 endonuclease I Surveyor assay was performed to detect genome modifications (FIG. 2c and FIG. 8b) and also analysed the mutation landscape by Illumina deep sequencing (FIG. 2d, FIG. 8c and FIG. 9) using EMX1 as the test genomic locus. Consistent with the flow cytometry-based studies, it was found that varying the linker length or composition alone generally did not improve the performance of the inducible system. Instead, increasing the copy number of ERT2 domains, particularly on the C-terminus of Cas9, resulted in an overall level of background activity that was not significantly different from the control plasmid that did not express a sgRNA ("no sgRNA"). The fusion of additional ERT2 domains did not inactivate the Cas9 enzyme, as all the tested variants showed an increase in the amount of genome modifications, e.g. insertions and deletions (INDELs), upon 1 µM 4-hydroxytamoxifen treatment, as determined by the Surveyor assay or by deep sequencing.

Next, all data was examined together to identify the best performing variants. The rank orders of the Cas9 variants in at least two out of the three assays agreed well with one another ($P<0.05$, Kolmogorov-Smirnov test) (FIG. 10). Notably, 8 out of the 30 Cas9 variants demonstrated a consistently lower level of background activity than the original ERT2-Cas9-ERT2 fusion (variant E) across all experiments (FIG. 11). However, only three of these (variants 27, 29, and 30), all of which were from group 4, showed consistent and robust editing activity upon induction (FIG. 2d). Hence, variants 27, 29, and 30 were pursued further, as these gave a high percentage of genome modifications with 4-hydroxytamoxifen but a low percentage of INDELS without 4-hydroxytamoxifen.

Characterization and Performance of iCas Under Different 4-Hydroxytamoxifen Treatment Regimes In previous experiments, HEK293 cells had been transfected with the relevant plasmids, incubated for 24 hours, and then treated the cells with 1 µM tamoxifen for another 24 hours. However, as the amount of Cas9 in the cell has to be tightly controlled, it was sought to ascertain the behaviour of the optimized Cas9 variants under various treatment conditions, because insufficient Cas9 will give rise to inefficient cleavage of the target genomic locus, while excess Cas9 may lead to unintended non-specific cleavage of off-target sites. Hence, the aim was to ascertain the behaviour of the optimized Cas9 variants under a range of tamoxifen treatment conditions, which would in turn determine the level of nuclease activity in the cell.

Three different concentrations of 4-hydroxtamoxifen (10 nM, 100 nM, and 1000 nM) and six durations of chemical treatment (2 hours, 4 hours, 6 hours, 8 hours, 16 hours, 24 hours, and 48 hours) were tested for variants 27, 30, and 29. The amount of genome modification at the EMX1 locus was quantified using the Surveyor assay (FIG. 3a and FIG. 12a). Cleavage activity was detected within 4 hours of 4-hydroxytamoxifen treatment for all the three variants, showing an increasing trend with longer treatment durations, which was further confirmed by deep sequencing (FIG. 12b) and appearing to plateau at around 8 hours. Notably, owing to its higher sensitivity, deep sequencing also revealed a low level of DNA editing after just 2 hours of 4-hydroxytamoxifen treatment. Additionally, it was found that 4-hydroxytamoxifen yielded a significantly lower level of nuclease activity at 10 nM than at 100 nM or 1,000 nM ($P<0.005$, Wilcoxon rank-sum test) (FIG. 13). Hence, either 100 nM or 1,000 nM of 4-hydroxytamoxifen was used in all subsequent experiments.

A key performance measure of an inducible system is whether the system exhibits any background activity in the absence of the inducer. Surveyor assay showed a low amount of genome modification at the EMX1 locus for all three variants without 4-hydroxytamoxifen treatment (0 nM). Leaky activity per se was observed only at the last time point (48 hours) for Variant 30 (FIG. 3a; FIG. 12b). From deep sequencing, leaky activity was first detected at 6 hours, 2 hours, and 16 hours for variants 27, 29, and 30, respectively (FIG. 12b) Subsequently, it was tested whether the three variants displayed any leaky activity at six other endogenous genomic loci, namely two sites in the promoter region of the VEGFA gene, two distinct sites in the intron of the WAS gene, one site in an intron of the TAT gene, and one site in the coding region of the FANCF gene. Genomic DNA was isolated 24 hours after transfection without any tamoxifen treatment and analysed using the Surveyor assay (FIG. 3). Consistent with the EMX1 results, a low amount of genome modification was observed at four loci for variant 27 and at two loci for variant 29. No cleavage bands were detected for variant 30 in the absence of the inducer. Additionally, the leakiness in activity observed for variants 27 and 29 became more pronounced overtime (FIG. 14).

At 24 hours after transfection with a FANCF-targeting plasmid, cells were treated with or without tamoxifen for another 24 hours before genomic DNA was isolated and analysed by the Surveyor assay (FIG. 10). Although strong cleavage bands were observed when the cells had been exposed to 100 nM or 1000 nM tamoxifen, respectively, for all the three Cas9 variants, it was also possible to detect an increase in genome modification for variant 27 and variant 29 in the absence of tamoxifen. Again, no cleavage bands were observed for variant 30 without tamoxifen treatment.

To verify the results from the Surveyor assays and deep sequencing experiments, immunohistochemical staining was performed to determine the subcellular localization of the three variants, all of which contained two copies of ERT2 at both termini of the enzyme ((ERT2)2-Cas9-(ERT2)2), with or without 1 µM 4-HT. 24 hours after transfection with plasmids carrying a Cas9 variant and a sgRNA targeting the EMX1, VEGFA, FANCF, WAS, or TAT genomic locus, the cells were either fixed immediately and stained with anti-V5 or were subjected to 6 h or 24 h 4-HT treatment before fixation and staining (FIG. 15). The percentage of cells that showed a nuclear localization of (ERT2)2-Cas9-(ERT2)2 was quantified (FIG. 3b). For all three Cas9 variants, it was observed that addition of 4-hydroxytamoxifen led to a significant increase in the percentages of cells exhibiting a nuclear localization of (ERT2)2-Cas9-(ERT2)2 ($P<0.05$, Student's t-test). Most of the protein translocation occurred within the first 6 hours of 4-hydroxytamoxifen treatment. Importantly, in the absence of 4-hydroxytamoxifen, cells that were transfected with variant 30 showed significantly less nuclear localization of (ERT2)2-Cas9-(ERT2)2 than cells that were transfected with variant 27 or variant 29 ($P<0.05$, Student's t-test). Collectively, these data indicated that variant 30 had less background activity than variants 27 and 29 across multiple loci, thereby suggesting that variant 30 could be used for precise control of genome editing. Hence, all subsequent experiments were performed with variant 30, hereafter referred to as iCas.

It was sought to test the robustness of iCas by using it to target the VEGFA promoter as well as the WAS, TAT, and FANCF genes for different durations of 1 µM 4-HT treatment (2 hours, 4 hours, 6 hours, 8 hours, 16 hours, and 24 hours). Consistently, the Surveyor assay showed nuclease activity within 4 hours of 4-hydroxytamoxifen treatment for all loci tested (FIG. 3c). The editing activity continued to increase with longer treatment durations. Additionally, iCas showed similarly fast responses to 4-hydroxytamoxifen in different human cell lines (FIG. 16), including the cancer cell lines MCF7, DLD1, and HCT116. These results indicate that iCas is a robust inducible genome-editing system in mammalian cells.

Specificity of iCas at Endogenous Off-Target Sites

To assess the DNA cleavage specificity of iCas, the modification of known Cas9 off-target sites of the EMX1, VEGFA, FANCF, WAS, and TAT sgRNAs was measured. Twenty-four hours after transfection, HEK293 cells were treated with 1 µM 4-hydroxytamoxifen for different durations (4 hours, 6 hours, 8 hours, 16 hours, and 24 hours) and used the Surveyor assay to assess editing activity at each off-target site (FIG. 3d and FIG. 17). Overall, cleavage at off-target sites tended to emerge later than at the corresponding on-target sites, or it occurred at lower levels, which was further confirmed by deep sequencing (FIG. 18). Nevertheless, the sgRNAs tested could be divided into three groups. In the first group, the sgRNAs were highly specific for their intended target (FIGS. 17a and 18a). For EMX1, the iCas system did not yield any measurable cleavage at the two off-target sites tested, but wild-type Cas9 produced off-target modifications as described previously (FIG. 19). In the second group, the sgRNAs were moderately specific, as exemplified by the TAT sgRNA (FIGS. 17b and 18b). Here, the optimal time window of 4-hydroxytamoxifen treatment for minimizing off-target effects appeared to be around 4 to 8 hours. In the third group, the sgRNAs were unspecific, and genome modifications could be detected at on-target and off-target sites at approximately the same time (FIGS. 17c and 18c). For these sgRNAs, it was not possible to tune the duration of chemical treatment to obtain the desired target genome modification without considerable off-target editing. Collectively, the data showed that limiting Cas9 activity is generally a viable strategy to improve the specificity of the endonuclease at most but not all genomic loci.

Comparison of iCas with a Promoter-Based Approach

As different methods may be adopted for inducible genome editing, iCas was compared with an alternative strategy whereby the wild-type Cas9 enzyme was expressed under a doxycycline (dox)-inducible promoter ($P_{TRE3G}$-Cas9). To this end, a previously reported STF3A cell line that carries a Wnt-responsive luciferase reporter and also strongly expresses a Wnt ligand was used, thereby giving high reporter activity. It was reasoned, without being bound by theory, that if β-catenin, a key signal transducer in the Wnt pathway, was inactivated, luciferase expression would be reduced considerably. Thus, it was sought to use iCas or PTRE3G-Cas9 to knock out CTNNB1, which encodes β-catenin, and to determine how rapidly each conditional system could perturb Wnt signalling upon induction. Firstly a gene encoding the Tet-On 3G transactivator, which binds to and activates expression from PTRE3G in the presence of doxycycline, was stably integrated into the STF3A cell line (FIG. 20a) and verified the functionality of the engineered (STF3A-Tet-On) cells (FIG. 20b). Next, iCas or $P_{TRE3G}$-Cas9 was used to target the second coding exon of CTNNB1 near the ATG start codon. 24 hours after transfection, cells were treated with 1 µM 4-hydroxytamoxifen or 1 µg/ml doxycycline for 6 hours, 12 hours, or 24 hours. The cells were then harvested for analysis using the Surveyor assay. iCas was consistently able to modify the target locus within 6 hours of 4-hydroxytamoxifen treatment, and the INDEL frequency increased with longer exposures to 4-hydroxytamoxifen (FIG. 4a). No cleavage bands were observed in the absence of 4-hydroxytamoxifen at any time point. However, for the $P_{TRE3G}$-Cas9 system, cleavage bands were only observed after the cells were exposed to doxycycline for 24 hours.

To demonstrate the impact of genome modification at the CTNNB1 locus, luciferase assays were performed on the STF3A Tet-On cell line after transfection with iCas or $P_{TRE3G}$-Cas9. Cells were treated for 6 hours with the respective chemical and then harvested after another 72 hours to allow sufficient time for changes in β-catenin or luciferase protein levels. It was verified that both the transcript and protein levels of β-catenin were downregulated in cells co-transfected with iCas and an CTNNB1-targeting sgRNA (FIG. 21). Consequently, a significant decrease in luciferase activity was observed in these cells (P<0.001, Student's t-test) (FIG. 4b). In contrast, there was no significant change in β-catenin expression or luciferase activity in cells transfected with an EMX1-targeting sgRNA or $P_{TRE3G}$-Cas9. Additionally, the expression profiles of known Wnt target genes paralleled the results from the luciferase assays (FIG. 4c and FIG. 22). Collectively, this data highlights the iCas system's advantage in speed over an alternative inducible-promoter approach in temporal control of genome-editing activity.

Benchmarking Different Post-Translational Control Systems

Two other chemical-inducible strategies that rely on post-translational control were recently reported, and it was sought to benchmark iCas against these other strategies. The best-performing intein-Cas9 and split-Cas9 constructs from these studies were cloned into the same plasmid backbone as iCas, and all experiments were performed side by side in HEK293 cells to ensure a fair comparison. The iCas and intein-Cas9 systems were induced with 1 µM 4-hydroxytamoxifen and the split-Cas9 system with 200 nM rapamycin, on the basis of published reports. For the comparison, the EMX1, TAT, and WAS genomic loci were targeted with or without the appropriate inducer. Different durations of chemical treatment were tested, and the extent of genome modification was measured by the Surveyor assay (FIG. 5a and FIG. 23a) and by deep sequencing (FIG. 24a). Overall, without the inducer, the split-Cas9 architecture showed the lowest level of background activity, and iCas and intein-Cas9 had comparable levels of leakiness. However, with the inducer, iCas consistently showed higher cleavage efficiency than intein-Cas9 and split-Cas9, at all time points and at all genomic loci. Notably, the amount of INDELs produced by active iCas was 1.6- to 4.8-fold higher than those produced by the reassembled split-Cas9 complex. Hence, without being bound by theory, the lower background observed in split-Cas9 appeared to be a consequence of an overall reduction in editing activity. Next, the switching ratio was calculated, which is defined as the extent of genome modification with the relevant inducer divided by the extent of genome modification without the inducer (FIG. 5b and FIGS. 23b and 24b). Overall, the iCas system and the split-Cas9 architecture produced similar switching ratios. However, in the Surveyor assay, iCas showed significantly higher ratios than intein-Cas9 at the EMX1 and WAS loci (P<0.1, Student's t-test), and in deep sequencing it showed significantly higher switching ratios than intein-Cas9 at all tested loci (P<0.05, Student's t-test). These results suggest that iCas is turned on more efficiently than intein-Cas9 upon addition of 4-hydroxytamoxifen.

Besides single gene targeting, the ability of iCas to perform multiplex genome engineering was compared with that of intein-Cas9 or split-Cas9. HEK293 cells were co-transfected with a sgRNA targeting EMX1 and another sgRNA targeting a coding exon of ADAR1 (ADAR), and subsequently the extent of genome modification was analysed by the Surveyor assay. After 12 hours of chemical treatment, it was observed that iCas generated INDELs at both the EMX1 and ADAR1 genomic loci (FIG. 5c). In contrast, intein-Cas9 and split-Cas9 did not produce detectable cleavage at any of the targeted locus. Additionally, after 24 hours of chemical treatment, iCas produced more genome modification than at 12 hours, and intein-Cas9 was also able to edit both the EMX1 and ADAR1 loci (FIG. 5d). However, split-Cas9 still did not edit any of the targeted genes. These results were further confirmed with a different pair of sgRNAs (FIG. 26c). Collectively, this data highlights the advantage of iCas over intein-Cas9 and split-Cas9 in performing conditional multiplex genome editing.

Repeated Toggling of iCas Activity

In principle, a conditional system such as iCas should allow users to generate stable cell lines and induce its activity whenever needed. To demonstrate this, retroviral transduction was used to establish a HEK293 cell line that stably expresses iCas (HEK293-iCas cells). The cell line was verified to be functional (FIG. 25a) and monitored the intracellular localization of iCas by immunofluorescence (FIG. 6a). Without 4-hydroxytamoxifen, most cells produced an iCas protein that was localized in the cytoplasm; only 15% of the cells contained nuclear-localized protein. However, upon 24 hour treatment with 4-hydroxytamoxifen, the proportion of cells with nuclear-localized protein increased significantly, to 48% (P<0.001, Student's t-test). The inducer was then washed away and the cells immunostained with anti-V5 antibody at 48 and 72 hours after removal of 4-hydroxytamoxifen. Quantification of microscopy images showed that by 72 hours, the percentage of cells with nuclear-localized protein had decreased to a level that was not significantly different from that of the pre-induction state (FIG. 6b).

Subsequently, the possibility of toggling the activity of iCas was explored (FIG. 25b). After 1 μM 4-hydroxytamoxifen treatment of HEK293 cells co-transfected with iCas and a first sgRNA targeting the WAS locus, the inducer was removed and 72 hours waiting time was allowed to pass, thereby allowing nuclear-localized iCas protein to exit the nucleus before introducing a second sgRNA targeting a coding exon of ASXL2. The cells were then either treated with 4-hydroxytamoxifen a second time or left untreated. From the Surveyor assay, cleavage activity was readily observed at both targeted loci for cells that were treated twice with the inducer (FIG. 6c); however, cleavage was detected only at the WAS locus in cells that were exposed to 4-hydroxytamoxifen after the first transfection but not after the second transfection, indicating that iCas was successfully switched off after the first induction event. Hence, these results show that iCas is a reversible genome-editing system.

Methods

Cell Culture and Transfection

All cell lines were cultured in Dulbecco's Modified Eagle Medium (DMEM) supplemented with 10% FBS, 2 mM L-Glutamine and 1% penicillin/streptomycin. Transfection was performed in 12-well plates at around 70% cell confluency using either Turbofect (Thermo Scientific) or Lipofectamine 2000 (Life Technologies), according to manufacturers' instructions. When necessary, cells were treated with varying concentrations of 4-hydroxytamoxifen (Sigma Aldrich).

PCR and Mutagenesis

All oligonucleotides for PCR and mutagenesis reactions were purchased from Integrated DNA Technologies (IDT). PCR was performed with MyTaq DNA Polymerase (Bio-Line), Phusion High-Fidelity DNA Polymerase (New England Biolabs), or Q5 High-Fidelity DNA Polymerase (New England Biolabs). For MyTaq, the following cycling parameters were used: 95° C. for 3 minutes, followed by 35 cycles of (95° C. for 30 seconds, 60° C. for 30 seconds, and 72° C. for 30 seconds), and then 72° C. for 2 minutes. For Phusion and Q5, the following cycling parameters were used: 98° C. for 3 minutes followed by 40 cycles of (98° C. for 15 seconds, 63° C. for 30 seconds, and 72° C. for 30 seconds), and then 72° C. for 2 minutes. Mutagenesis was performed using QuikChange Lightning Site-Directed Mutagenesis kit (Agilent Technologies) according to manufacturer's instructions, in order to incorporate novel restriction sites or DNA linker fragments into the CRISPR-Cas9 variant plasmids. Mutagenic primers were designed using the QuikChange Primer Design Tool (http://www.genomics.agilent.com/primerDesignProgram.jsp).

Construction of Cas9 Variants

The GeneArt CRISPR nuclease vector (Life Technologies), which contains a human codon-optimized *Streptococcus pyogenes* Cas9 enzyme with a V5 epitope tag, was used as the wildtype Cas9 expression plasmid. The ERT2 domain was isolated using PCR from the pCAG-ERT2-Cre-ERT2 plasmid (Addgene #13777) and cloned into the pCR-BluntII-TOPO vector (Life Technologies). Different linkers and restriction sites were added using the QuikChange Lightning kit (Agilent Technologies). Each of the modified ERT2 fragment was flanked with either AgeI and SfoI or EcoRI and XbaI cut sites for cloning into the N- or C-terminus of Cas9 respectively. All Cas9 variants were confirmed by Sanger sequencing.

GFP Disruption Assay

HEK293-GFP stable cells were purchased from GenTarget. One day after seeding, cells were transfected using Lipofectamine 2000 (Life Technologies) according to manufacturer's instructions, with efficiency reaching at least about 70% per well. Experimental cells were treated with 1 mM 4-hydroxytamoxifen (Sigma Aldrich), while control cells remained in culture media devoid of tamoxifen. 5 days after transfection, cells were trypsinised and resuspended in PBS containing 2% FBS for analysis by flow cytometry. All the data were normalized to the average fluorescence intensity of cells transfected with a plasmid that did not express any sgRNA.

Generation of STF3A-TetOn Stable Cells

STF3A cells were modified to stably express the Tet-On 3G transactivator protein via retroviral transduction and drug selection. Briefly, to generate retroviruses, GP2-293 cells were transfected at around 70% confluence with a transfection mix comprising 20 μg pCMV-VSVG envelope vector, 50 μg pRETROX-TET3G vector (CloneTech), and 140 d Lipofectamine 2000 (LifeTechnologies) diluted in 3.75 ml Opti-MEM (Life Technologies) and 7.5 ml DMEM containing 10% FBS. The transfection mix was substituted with 10 ml DMEM containing 5% FBS after 6 hours of incubation at 37° C. Retrovirus-containing medium was harvested after 24 hours and purified using Amicon Ultra-15 Centrifugal Filter Units (Merck Millipore). STF3A cells were then infected twice with 20 μl retroviruses each time and subsequently selected in DMEM containing 500 μg/ml G418 over 5 days. To test the expression of the transactivator gene, STF3A-TetOn cells were transfected with 1 µg pTRE-tdTomato vector (Addgene #50798) and observed for red fluorescence 24 hours after treatment with 1 µg/ml doxycycline.

Luciferase Assay

STF3A-TetOn cells were transfected with 1 µg iCas or pTRE3G-Cas9 and treated with 1 µM tamoxifen or 1 µg/ml doxycycline respectively for 6 hours. The cells were then trypsinised and re-seeded equally into a Corning 96-well flat clear bottom white plate. Samples were assayed for luciferase activity using Dual-Glo Luciferase (Promega) according to manufacturer's instructions. All measurements were taken using the i-control software for Tecan microplate readers. All firefly luciferase measurements were normalized to the corresponding renilla luciferase readings.

Surveyor Cleavage Assay

Genomic DNA was isolated from cells using the DNeasy Blood and Tissue Kit (Qiagen) and the loci-of-interest were amplified using Q5 High-Fidelity DNA Polymerase (New England Biolabs; see Table 3 for list of primers). The PCR products were purified using the GeneJET Gel Extraction Kit (Thermo Scientific). Subsequently, 250 ng DNA was incubated at 95° C. for 5 minutes in 1× NEBuffer 2 and then slowly cooled at a rate of −0.1° C./second. After annealing, 5 U T7 endonuclease I (New England Biolabs) was added to each sample and the reactions were incubated at 37° C. for 50 minutes. The T7E1-digested products were separated on a 2.5% agarose gel stained with GelRed (Biotium) and the gel bands were quantified using ImageJ.

Illumina Deep Sequencing

Sequencing libraries were constructed via two rounds of PCR. In the first round, the loci-of-interest were amplified from genomic DNA using Q5 High-Fidelity DNA Polymerase (New England Biolabs) and the primers listed in Supplementary Table 4. Each forward primer contains the common sequence GCG TTA TCG AGG TC, while each reverse primer contains the common sequence GTG CTC TTC CGA TCT. In the second round, the PCR products from the first round were barcoded using Phusion High-Fidelity DNA Polymerase (New England Biolabs) and the following primers: Forward—AAT GAT ACG GCG ACC ACC GAG ATC TAC ACC CTA CAC GAG CGT TAT CGA GGT C; Reverse—CAA GCA GAA GAC GGC ATA CGA GAT (barcode) GTG ACT GGA GTT CAG ACG TGT GCT CTT CCG ATC T. 10 bp barcodes designed by Fluidigm for the Access Array System were used. All samples were sequenced on MiSeq (Illumina) to produce paired 151 bp reads.

Cell Fractionation

HEK293 cells were fractionated using the Rapid Efficient And Practical (REAP) method. Briefly, the cells were scraped in ice-cold PBS, collected into 1.5 ml Eppendorf tubes, and pop-spun for 10 seconds in a table-top centrifuge. The supernatant was discarded and the pellet was lysed with 0.10% Igepal CA630 (Sigma Aldrich) in PBS supplemented with protease inhibitor (Calbiochem). Whole cell lysates were aliquoted and the remainder was pop-spun for 10 seconds. The supernatant, comprising the cytosolic fraction, was collected into a new tube. The pellet, comprising the nuclear fraction, was resuspended using 0.1% Igepal CA630 in PBS with protease inhibitor. Whole cell lysates and nuclear fractions were subjected to 10 cycles of sonication (each cycle consisted of 30 seconds sonication followed by 30 seconds rest).

Western Blot Analysis

Proteins from whole cell lysates, nuclear fractions, and cytosolic fractions were loaded in equal amounts for SDS PAGE and then transferred onto a nitrocellulose membrane for western blot. The primary antibodies used were α-V5 (Life Technologies, 1:8000 dilution), α-3PGDH (Santa Cruz, 1:1000 dilution), and α-total histone H3 (Abcam, 1:10000 dilution). Primary antibodies were diluted in TBST+5% milk and incubated overnight at 4° C. Secondary antibodies were used at a 1:2500 dilution in TBST+5% milk. Membranes were exposed after addition of WesternBright Sirius HRP substrate (Advansta).

Immunohistochemistry

Paraformaldehyde-fixed HEK293 cells were first incubated with blocking solution (10% FBS in 0.1M PBS) (JR Scientific Inc) for 30 minutes and then quenched with 3% hydrogen peroxide. Next, the samples were incubated for 2 hours at room temperature or 4° C. overnight with primary antibody specific against the V5 epitope tag (Life Technologies) in blocking solution. Negative controls were incubated with blocking solution without any primary antibody. Subsequently, the samples were thoroughly washed with PBS and then incubated for 1 hour at room temperature with secondary horseradish peroxidase (HRP)-conjugated antibody (GE Healthcare UK Ltd). After further incubation with DAB substrate (Vector Laboratories) for 10 minutes at room temperature, the cover slips were washed with distilled water, counter-stained with hematoxylin (Vector Laboratories) for 10 minutes to reveal cellular material, and mounted onto glass slides (Thermo Scientific). All slides were viewed and imaged using a light microscope (Zeiss Axio Imager Z1 with attached Leica Axiocam MRc5 camera) with the appropriate filters.

Tables

TABLE 1

List of Cas9 variants constructed and tested. Amino acids for the different protein linkers are given in bold letters.

| SEQ ID NO. | No. | Details |
|---|---|---|
| 220 | 1 | NLS-TG-ERT2-SGSETPGTSESAGA-Cas9-NLS-ERT2 |
| 221 | 2 | NLS-TG-ERT2-SGSEGA-Cas9-NLS-ERT2 |
| 222 | 3 | NLS-TG-ERT2-GGSGGSGA-Cas9-NLS-ERT2 |
| 223 | 4 | NLS-TG-ERT2-GTSESATPESGGA-Cas9-NLS-ERT2 |
| 224 | 5 | NLS-TG-ERT2-SGSETPGTGA-Cas9-NLS-ERT2 |
| 225 | 6 | NLS-TG-ERT2-SESATPESGA-Cas9-NLS-ERT2 |
| 226 | 7 | NLS-TGGGS-ERT2-SGSETPGTGA-Cas9-NLS-ERT2 |
| 227 | 8 | NLS-TGGGS-ERT2-SGSETPGTPGGA-Cas9-NLS-ERT2 |
| 228 | 9 | NLS-TG-ERT2-GASGSKTPG-Cas9-NLS-ERT2 |
| 229 | 10 | NLS-TG-ERT2-TPESGA-Cas9-NLS-ERT2 |
| 230 | 11 | NLS-TGPGGS-ERT2-GA-Cas9-NLS-ERT2 |

TABLE 1 -continued

List of Cas9 variants constructed and tested. Amino acids for the different protein linkers are given in bold letters.

| SEQ ID NO. | No. | Details |
|---|---|---|
| 231 | 12 | NLS-TGGGS-ERT2-SGSETPGTSEGA-Cas9-NLS-ERT2 |
| 232 | 13 | NLS-TGGGS-ERT2-TPESGA-Cas9-NLS-ERT2 |
| 233 | 14 | NLS-TGPGGSAGDTTGPGGS-ERT2-GA-Cas9-NLS-ERT2 |
| 234 | 15 | NLS-TGGGS-ERT2-SESATPESGA-Cas9-NLS-ERT2 |
| 235 | 16 | NLS-TGGGS-ERT2-SGSEGA-Cas9-NLS-ERT2 |
| 236 | 17 | NLS-TG-ERT2-PG-Cas9-NLS-ERT2 |
| 237 | 18 | NLS-TG-ERT2-GA-Cas9-NLS-SGS-ERT2 |
| 238 | 19 | NLS-TG-ERT2-GA-Cas9-NLS-GGGS-ERT2 |
| 239 | 20 | NLS-TG-ERT2-GGSPRGGS-ERT2-TPESGA-Cas9-NLS-ERT2 |
| 240 | 21 | NLS-TGGGS-ERT2-GGSPRGGS-ERT2-TPESGA-Cas9-NLS-ERT2 |
| 241 | 22 | NLS-TGGGS-ERT2-PRGGS-ERT2-TPESGA-Casg-NLS-ERT2 |
| 242 | 23 | NLS-TG-ERT2-GA-Cas9-NLS-ERT2-PAG-ERT2 |
| 243 | 24 | NLS-TG-ERT2-GA-Cas9-NLS-ERT2-PAGGGS-ERT2 |
| 244 | 25 | NLS-TG-ERT2-GGSPRGGS-ERT2-TPESGA-Cas-NLS-ERT2-PAGGGS-ERT2 |
| 245 | 26 | NLS-TGGGS-ERT2-GGSPRGGS-ERT2-TPESGA-Cas9-NLS-ERT2-PAGGGS-ERT2 |
| 246 | 27 | NLS-TGGGS-ERT2-PRGGS-ERT2-TPESGA-Cas9-NLS-ERT2-PAG-ERT2 |
| 247 | 28 | NLS-TGGGS-ERT2-GGSPRGGS-ERT2-TPESGA-Cas9-NLS-ERT2-PAG-ERT2 |
| 248 | 29 | NLS-TG-ERT2-GGSPRGGS-ERT2-TPESGA-Cas9-NLS-ERT2-PAG-ERT2 |
| 249 | 30 | NL-TGGGS-ERT2-PRGGS-ERT2-TPESGA-Cas9-NLS-ERT2-PAGGGS-ERT2 |

TABLE 2

Non-specific off-target sites investigated in this study.

| | | | |
|---|---|---|---|
| EMX1 | Chr2:73160982 | On | GAGTCCGAGCAGAAGAAGAAggg (SEQ ID NO: 75) |
| | Chr5:45359083 | Off 1 | GAGTTAGAGCAGAAGAAGAAagg (SEQ ID NO: 76) |
| | Chr15:44109747 | Off 2 | GAGTCTAAGCAGAAGAAGAAgag (SEQ ID NO: 77) |
| VEGFA P1 | Chr6:43737313 | On | GGGTGGGGGAGTTTGCTCCtgg (SEQ ID NO: 78) |
| | Chr15:65637553 | Off 1 | GGATGGAGGGAGTTTGCTCCtgg (SEQ ID NO: 79) |
| | Chr17:39796344 | Off 2 | TAGTGGAGGGAGCTTGCTCCtgg (SEQ ID NO: 80) |
| | Chr1:99347667 | Off 3 | GGGGAGGGGAAGTTTGCTCCtgg (SEQ ID NO: 81) |
| VEGFA P2 | Chr6:43737454 | On | GGTGAGTGAGTGTGTGCGTGtgg (SEQ ID NO: 82) |
| | Chr9:16681608 | Off 1 | AGTGAGTGAGTGTGTGTGTGggg (SEQ ID NO: 83) |
| | Chr5:89440985 | Off 2 | AGAGAGTGAGTGTGTGCATGagg (SEQ ID NO: 84) |
| | Chr5:115434659 | Off 3 | TGTGGGTGAGTGTGTGCGTGagg (SEQ ID NO: 85) |
| | Chr22:37662840 | Off 4 | GCTGAGTGAGTGTATGCGTGtgg (SEQ ID NO: 86) |
| WAS I1 | ChrX:48544569 | On | TGGATGGAGGAATGAGGAGTtgg (SEQ ID NO: 87) |
| | Chr1:30597854 | Off 1 | TGGATGGAGGGATGAGGAGTggg (SEQ ID NO: 88) |
| | Chr2:242451414 | Off 2 | GGGATGGAGGGATGAGGAGTggg (SEQ ID NO: 89) |
| | Chr18:21810215 | Off 3 | AGGAGGGAGGAATGGGGAGTtgg (SEQ ID NO: 90) |
| WAS I2 | ChrX:48544562 | On | CCCATCCATCCAGACACAggg (SEQ ID NO: 91) |
| | ChrX:90817748 | Off 1 | CTCTTCCACCCAGAGACACAggg (SEQ ID NO: 92) |

TABLE 2-continued

Non-specific off-target sites investigated in this study.

| | | | |
|---|---|---|---|
| TAT | Chr16:71609818 | On | TCCTCCTGAGACTCCATACCtgg (SEQ ID NO: 93) |
| | Chr6:12810776 | Off 1 | CCATCCTGAGACTCCATACCtgg (SEQ ID NO: 94) |
| FANCF | Chr11:22647354 | On | GGAATCCCTTCTGCAGCACCtgg (SEQ ID NO: 95) |
| | Chr18:8707544 | Off 1 | GGAACCCCGTCTGCAGCACCagg (SEQ ID NO: 96) |
| | Chr10:43410014 | Off 2 | GGAGTCCCTCCTACAGCACCagg (SEQ ID NO: 97) |
| | Chr10:37953183 | Off 3 | GGAGTCCCTCCTACAGCACCagg (SEQ ID NO: 98) |
| | Chr17:78923961 | Off 4 | AGAGGCCCCTCTGCAGCACCagg (SEQ ID NO: 99) |

TABLE 3

PCR primers used for the Surveyor cleavage assay.

| Primer Name | Primer Sequence |
|---|---|
| EMX1_On_Set1_FOR | GCC CCT AAC CCT ATG TAG CC (SEQ ID NO: 100) |
| EMX1_On_Set1_REV | GGA GAT TGG AGA CAC GGA GA (SEQ ID NO: 101) |
| EMX1_On_Set2_FOR | CTG TGT CCT CT CCT GCC CT (SEQ ID NO: 102) |
| EMX1_On_Set2_REV | CTC TCC GAG GAG AAG GCC AA (SEQ ID NO: 103) |
| EMX1_Off1_FOR | TTG AGA CAT GGG GAT AGA ATC A (SEQ ID NO: 104) |
| EMX1_Off1_REV | CAG GAA TAG CCC TAC AAA GGT G (SEQ ID NO: 105) |
| EMX1_Off2_FOR | GTT CTG TAA ACG CCG TAG CC (SEQ ID NO: 106) |
| EMX1_Off2_REV | GGA TGC AGT CTG CCT TTT TG (SEQ ID NO: 107) |
| PPP1R12C_On_Set1_FOR | GTC TAA CCC CCA CCT CCT GT (SEQ ID NO: 108) |
| PPP1R12C_On_Set1_REV | ACA CCT AGG ACG CAC CAT TC (SEQ ID NO: 109) |
| PPP1R12C_On_Set2_FOR | CGG TTA ATG TGG CTC TGG TT (SEQ ID NO: 110) |
| PPP1R12C_On_Set2_REV | CGC ACG GAG GAA CAA TAT AAA (SEQ ID NO: 111) |
| VEGFA_Promoter1_On_Set1_FOR | CTG GAC ACT TCC CAA AGG AC (SEQ ID NO: 112) |
| VEGFA_Promoter1_On_Set1_REV | AGG GAG CAG GAA AGT GAG GT (SEQ ID NO: 113) |
| VEGFA_Promoter1_On_Set2_FOR | TCA CTG ACT AAC CCC GGA AC (SEQ ID NO: 114) |
| VEGFA_Promoter1_On_Set2_REV | CTG AGA GCC GTT CCC TCT TT (SEQ ID NO: 115) |
| VEGFA_Promoter1_Off1_FOR | GGG CTA GAG TGT AGT GGC ACA (SEQ ID NO: 116) |
| VEGFA_Promoter1_Off1_REV | GCC CTG TTT TCA TCC TAC ACA (SEQ ID NO: 117) |

TABLE 3-continued

PCR primers used for the Surveyor cleavage assay.

| Primer Name | Primer Sequence |
|---|---|
| VEGFA_Promoter1_Off2_FOR | AAG TTG GGC AAG AGT CCA GA (SEQ ID NO: 118) |
| VEGFA_Promoter1_Off2_REV | ACC AGC AGA GGA AGG GCT AT (SEQ ID NO: 119) |
| VEGFA_Promoter1_Off3_FOR | TGC CAT TTT TAA GCC ATC AG (SEQ ID NO: 120) |
| VEGFA_Promoter1_Off3_REV | AGC CCA TTC TTT TTG CAG TG (SEQ ID NO: 121) |
| VEGFA_Promoter2_On_FOR | CCA GAT GGC ACA TTG TCA GA (SEQ ID NO: 122) |
| VEGFA_Promoter2_On_REV | CCA AGG TTC ACA GCC TGA AA (SEQ ID NO: 123) |
| VEGFA_Promoter2_Off1_FOR | GCC GTC TGT TAG AGG GAC AA (SEQ ID NO: 124) |
| VEGFA_Promoter2_Off1_REV | GTC TTC CCC CAA CCT CCA GT (SEQ ID NO: 125) |
| VEGFA_Promoter2_Off2_FOR | GGC CCA ATC TTA GTG TTT CAG A (SEQ ID NO: 126) |
| VEGFA_Promoter2_Off2_REV | TGG TTA AAA GCA AAG GAT GTG A (SEQ ID NO: 127) |
| VEGFA_Promoter2_Off3_FOR | CCC TCG CTA GAT ACT GAG GAA A (SEQ ID NO: 128) |
| VEGFA_Promoter2_Off3_REV | TGG CCA AGA TAA GGA AAC AAC (SEQ ID NO: 129) |
| VEGFA_Promoter2_Off4_FOR | TGA TTC CGC TGA CAC GTA AC (SEQ ID NO: 130) |
| VEGFA_Promoter2_Off4_REV | TTC AGA GCC TCT CAC CAC CT (SEQ ID NO: 131) |
| WAS_Intron1-2_On_Set1_FOR | CAG CCA ATG AAG GTG AGT CC (SEQ ID NO: 132) |
| WAS_Intron1-2_On_Set1_REV | GTG GAT CCC ACA AAC CAT TC (SEQ ID NO: 133) |
| WAS_Intron1-2_On_Set2_FOR | AGG AAT CAG AGG CAA AGT GG (SEQ ID NO: 134) |
| WAS_Intron1-2_On_Set2_REV | TCC CAT CAA TTC ATC CCT CT (SEQ ID NO: 135) |
| WAS_Intron1_Off1_FOR | CTG TCC TCT CTG CAG GAA CC (SEQ ID NO: 136) |
| WAS_Intron1_Off1_REV | GTC TGG ATC CCT GCA TCA CT (SEQ ID NO: 137) |
| WAS_Intron1_Off2_FOR | CGA GGT TCC AGA ATG CTC TT (SEQ ID NO: 138) |
| WAS_Intron1_Off2_REV | GGG AGG CTA AAC CCT GAA AC (SEQ ID NO: 139) |
| WAS_Intron1_Off3_FOR | TCT TCA ATG TTC CCC CAC AT (SEQ ID NO: 140) |
| WAS_Intron1_Off3_REV | AGG CTG CCA TTG TCT GAA GT (SEQ ID NO: 141) |
| WAS_Intron2_Off1_Set1_FOR | TCT CAG AGA TAC AAG GGA AAT CG (SEQ ID NO: 142) |

TABLE 3-continued

PCR primers used for the Surveyor cleavage assay.

| Primer Name | Primer Sequence |
|---|---|
| WAS_Intron2_Off1_Set1_REV | CCA GCA GAC TCT GGG TCT ATT TA (SEQ ID NO: 143) |
| WAS_Intron2_Off1_Set2_FOR | TAC AAG GGA AAT CGT GAG ACC (SEQ ID NO: 144) |
| WAS_Intron2_Off1_Set2_REV | AGT CAG CAT GCA GAT TCT GGT (SEQ ID NO: 145) |
| TAT_On_FOR | GAC AAC ATG AAG GTG AAA CCA A (SEQ ID NO: 146) |
| TAT_On_REV | GTC AAA GAA AGC CAG GAA AGA A (SEQ ID NO: 147) |
| TAT_Off1_FOR | TGT GGT TGG TTG GTT TGT TG (SEQ ID NO: 148) |
| TAT_Off1_REV | GTG ACC AAG CAG GCT CTT TC (SEQ ID NO: 149) |
| FANCF_On_FOR | ACC TCT TTG TGT GGC GAA AG (SEQ ID NO: 150) |
| FANCF_On_REV | CCA GGC TCT CTT GGA GTG TC (SEQ ID NO: 151) |
| FANCF_Off1_FOR | CAG ACT TCA CCA CCA TGC AC (SEQ ID NO: 152) |
| FANCF_Off1_REV | GGC CAG TCC TTT GTA AGC AT (SEQ ID NO: 153) |
| FANCF_Off2_FOR | AAT GTA AGA GGC AAC CAA AGG A (SEQ ID NO: 154) |
| FANCF_Off2_REV | GTT AAT GGA AGG TGA AGG CAG T (SEQ ID NO: 155) |
| FANCF_Off3_FOR | AAT GCA AGA GGC AAA CAA AAA (SEQ ID NO: 156) |
| FANCF_Off3_REV | CCA ACA TCT TCA CAA GGG TTC (SEQ ID NO: 157) |
| FANCF_Off4_FOR | CAA CCT TCA TCC TTG GCT TG (SEQ ID NO: 158) |
| FANCF_Off4_REV | GAG ACA GAG CCA TGC AAC CTA (SEQ ID NO: 159) |
| CTNNB_1_On_FOR | GCC ACC AGC AGG AAT CTA GT (SEQ ID NO: 160) |
| CTNNB_1_On_REV | TCA AAA CTG CAT TCT GAC TTT CA (SEQ ID NO: 161) |
| ADAR1_On_FOR | GGG CAG GAA CCT GTC ATA AA (SEQ ID NO: 162) |
| ADAR1_On_REV | CCC TTG TTC AGC CAA GAT TC (SEQ ID NO: 163) |
| TCF7_On_FOR | TTC CTT CCC AAG TCA GGA ACT (SEQ ID NO: 164) |
| TCF7_On_REV | TAT GGG AGA AAA GAC CAG CAC (SEQ ID NO: 165) |
| PARP4_On_FOR | GGA CTT CCA GCT TTT TGC AC (SEQ ID NO: 166) |
| PARP4_On_REV | TTG CTC TCG GGA TTT TAG GA (SEQ ID NO: 167) |

TABLE 3-continued

PCR primers used for the Surveyor cleavage assay.

| Primer Name | Primer Sequence |
| --- | --- |
| ASXL2_On_FOR | CAT GGC AGC CCC TTT CTA T (SEQ ID NO: 168) |
| ASXL2_On_REV | GCC TGG CCA TAA GTC ATT TT (SEQ ID NO: 169) |

TABLE 4

PCR primers used for making Illumina sequencing libraries.

| Primer Name | Primer Sequence |
| --- | --- |
| EMX1_On_Adapter_FOR | GCG TTA TCG AGG TCG GGC CTC CTG AGT TTC TCA T (SEQ ID NO: 170) |
| EMX1_On_Adapter_REV | GTG CTC TTC CGA TCT GTG GTT GCC CAC CCT AGT C (SEQ ID NO: 171) |
| EMX1_Off1_Adapter_FOR | GCG TTA TCG AGG TCT GCA CAT GTA TGT ACA GGA GTC AT (SEQ ID NO: 172) |
| EMX1_Off1_Adapter_REV | GTG CTC TTC CGA TCT CAC CTT TTA AGA TCT GAC AGA GAA A (SEQ ID NO: 173) |
| EMX1_Off2_Adapter_FOR | GCG TTA TCG AGG TCT GGG CGA GAA AGG TAA CTT ATG (SEQ ID NO: 174) |
| EMX1_Off2_Adapter_REV | GTG CTC TTC CGA TCT ACT GTT TCA CTG CCT ACC TTC C (SEQ ID NO: 175) |
| PPP1R12C_On_Adapter_Set1_FOR | GCG TTA TCG AGG TCG ATC AGT GAA ACG CAC CAG A (SEQ ID NO: 176) |
| PPP1R12C_On_Adapter_Set1_REV | GTG CTC TTC CGA TCT GTC TAA CCC CCA CCT CCT GT (SEQ ID NO: 177) |
| PPP1R12C_On_Adapter_Set2_FOR | GCG TTA TCG AGG TCG TCA GAG CAG CTC AGG TTC TG (SEQ ID NO: 178) |
| PPP1R12C_On_Adapter_Set2_REV | GTG CTC TTC CGA TCT TAG GCC TCC TCC TTC CTA GTC T (SEQ ID NO: 179) |
| VEGFA_Promoter1_On_Adapter_FOR | GCG TTA TCG AGG TCG CAC ATT GTC AGA GGG ACA C (SEQ ID NO: 180) |
| VEGFA_Promoter1_On_Adapter_REV | GTG CTC TTC CGA TCT CAC ACG TCC TCA CTC TCG AA (SEQ ID NO: 181) |
| VEGFA_Promoter1_Off1_Adapter_FOR | GCG TTA TCG AGG TCT CTC AAA CTC CTG GGC TCA A (SEQ ID NO: 182) |
| VEGFA_Promoter1_Off1_Adapter_REV | GTG CTC TTC CGA TCT CTG GTT TTT GGT TTG GGA AA (SEQ ID NO: 183) |
| VEGFA_Promoter1_Off2_Adapter_FOR | GCG TTA TCG AGG TCC CCT CTC CAT GAA ACT TGC (SEQ ID NO: 184) |

TABLE 4-continued

PCR primers used for making Illumina sequencing libraries.

| Primer Name | Primer Sequence |
|---|---|
| VEGFA_Promoter1_Off2_Adapter_REV | GTG CTC TTC CGA TCT AGG GCA AAA CAG GAG AAC AG (SEQ ID NO: 185) |
| VEGFA_Promoter1_Off3_Adapter_FOR | GCG TTA TCG AGG TCG CAT CTC TGC CTT CAT TGC T (SEQ ID NO: 186) |
| VEGFA_Promoter1_Off3_Adapter_REV | GTG CTC TTC CGA TCT GCC TAC TCC AGG GTT TCT CA (SEQ ID NO: 187) |
| VEGFA_Promoter2_On_Adapter_FOR | GCG TTA TCG AGG TCG CAG ACG GCA GTC ACT AGG (SEQ ID NO: 188) |
| VEGFA_Promoter2_On_Adapter_REV | GTG CTC TTC CGA TCT CCG TTC CCT CTT TGC TAG G (SEQ ID NO: 189) |
| VEGFA_Promoter2_Off1_Adapter_FOR | GCG TTA TCG AGG TCG ATC CGG TGC TGC AGT GA (SEQ ID NO: 190) |
| VEGFA_Promoter2_Off1_Adapter_REV | GTG CTC TTC CGA TCT GCT CTC CAC CTC GAT GTC A (SEQ ID NO: 191) |
| VEGFA_Promoter2_Off2_Adapter_FOR | GCG TTA TCG AGG TCT CAA AGT TTC ACA TGG TTG C (SEQ ID NO: 192) |
| VEGFA_Promoter2_Off2_Adapter_REV | GTG CTC TTC CGA TCT GTG TGG AGG GTG GGA CCT (SEQ ID NO: 193) |
| VEGFA_Promoter2_Off3_Adapter_FOR | GCG TTA TCG AGG TCA TTA TGC GTA TTC AGG GTG TGC (SEQ ID NO: 194) |
| VEGFA_Promoter2_Off3_Adapter_REV | GTG CTC TTC CGA TCT GCT GGT CAG AGG GTA CAA CTT TT (SEQ ID NO: 195) |
| VEGFA_Promoter2_Off4_Adapter_FOR | GCG TTA TCG AGG TCG GTT AGG AGA GCT GGC TTG GA (SEQ ID NO: 196) |
| VEGFA_Promoter2_Off4_Adapter_REV | GTG CTC TTC CGA TCT CTG GCC TCG GCC TCT CA (SEQ ID NO: 197) |
| WAS_Intron1-2_On_Adapter_FOR | GCG TTA TCG AGG TCG GCA GGG CTG TGA TAA CTC T (SEQ ID NO: 198) |
| WAS_Intron1-2_On_Adapter_REV | GTG CTC TTC CGA TCT ATC TAC CGC CAA TCC ATC C (SEQ ID NO: 199) |
| WAS_Intron1_Off1_Adapter_FOR | GCG TTA TCG AGG TCA CGG CAT GGA ATT ATT TGG TT (SEQ ID NO: 200) |
| WAS_Intron1_Off1_Adapter_REV | GTG CTC TTC CGA TCT GCC TGG GAG AGA AAT CAA CTC (SEQ ID NO: 201) |
| WAS_Intron1_Off2_Adapter_FOR | GCG TTA TCG AGG TCA CTG TGT AGG AAG CCC ACT CTC (SEQ ID NO: 202) |
| WAS_Intron1_Off2_Adapter_REV | GTG CTC TTC CGA TCT AAA GCT TGG TGA CAG TGA AAT G (SEQ ID NO: 203) |

TABLE 4-continued

PCR primers used for making Illumina sequencing libraries.

| Primer Name | Primer Sequence |
|---|---|
| WAS_Intron1_Off3_Adapter_FOR | GCG TTA TCG AGG TCC ATG AAG GGA AGA GGT GCA T (SEQ ID NO: 204) |
| WAS_Intron1_Off3_Adapter_REV | GTG CTC TTC CGA TCT CCA ACG TGA CCC TTT TTG AG (SEQ ID NO: 205) |
| WAS_Intron2_Off1_Adapter_FOR | GCG TTA TCG AGG TCT CAC AGT CTC TTC CCC TGC T (SEQ ID NO: 206) |
| WAS_Intron2_Off1_Adapter_REV | GTG CTC TTC CGA TCT CTT GGC CAG TGT CTT TCC AT (SEQ ID NO: 207) |
| TAT_On_Adapter_FOR | GCG TTA TCG AGG TCT GTG TTT GGA AAC CTG CCT A (SEQ ID NO: 208) |
| TAT_On_Adapter_REV | GTG CTC TTC CGA TCT CCA AAT CCA AAG GAC CAT GT (SEQ ID NO: 209) |
| TAT_Off1_Adapter_FOR | GCG TTA TCG AGG TCC ATC CCC TGG CAT CTA GAA A (SEQ ID NO: 210) |
| TAT_Off1_Adapter_REV | GTG CTC TTC CGA TCT TCA CTA CCT GGT GGC TAT GG (SEQ ID NO: 211) |
| FANCF_On_Adapter_FOR | GCG TTA TCG AGG TCA GCA TTG CAG AGA GGC GTA T (SEQ ID NO: 212) |
| FANCF_On_Adapter_REV | GTG CTC TTC CGA TCT ATG GAT GTG GCG CAG GTA G (SEQ ID NO: 213) |
| FANCF_Off1_Adapter_FOR | GCG TTA TCG AGG TCC ACA GAT TGA TGC CAC TGG A (SEQ ID NO: 214) |
| FANCF_Off1_Adapter_REV | GTG CTC TTC CGA TCT ACG CCA GCA CTT TCT AAG GA (SEQ ID NO: 215) |
| FANCF_Off2-3_Adapter_FOR | GCG TTA TCG AGG TCT TAC CAG ATG GAG GAC AGT GA (SEQ ID NO: 216) |
| FANCF_Off2-3_Adapter_REV | GTG CTC TTC CGA TCT ACC AGT TTG AGA CCT CTG ACC (SEQ ID NO: 217) |
| FANCF_Off4_Adapter_FOR | GCG TTA TCG AGG TCG GCT CTG GGT ACA GTT CTG C (SEQ ID NO: 218) |
| FANCF_Off4_Adapter_REV | GTG CTC TTC CGA TCT GCC ACA GAC GAA GAC ACA GA (SEQ ID NO: 219) |

TABLE 1

List of #Cas9 variants constructed and tested. Amino acids for the different protein linkers are given in bold.

| SEQ ID No. | No. | Details |
|---|---|---|
| 15 | 17 | NLS-PR-ERT2-PG-Cas9-ERT2 |
| 16 | 2 | NLS-TG-ERT2-SGSEGA-Cas9-ERT2 |
| 17 | 9 | NLS-TG-ERT2-GASGSKTPG-Cas9-ERT2 |
| 18 | 1 | NLS-TG-ERT2-SGSETPGTSESAGA-Cas9-ERT2 |
| 19 | 5 | NLS-TG-ERT2-SGSETPGTGPGGA-Cas9-ERT2 |
| 20 | 6 | NLS-TG-ERT2-SESATPESGA-Cas9-ERT2 |
| 21 | 4 | NLS-TG-ERT2-GTSESATPESGGA-Cas9-ERT2 |
| 22 | 3 | NLS-TG-ERT2-GGSGGSGA-Cas9-ERT2 |
| 23 | 11 | NLS-TGPGPGGS-ERT2-GA-Cas9-ERT2 |
| 24 | 14 | NLS-TGPGPGGSAGDTTGPGTGPG-ERT2-GA-Cas9-ERT2 |
| 25 | 19 | NLS-TG-ERT2-GA-Cas9-GGGS-ERT2 |
| 26 | 13 | NLS-TGGGS-ERT2-TPESGA-Cas9-ERT2 |
| 27 | 15 | NLS-TGGGS-ERT2-SESATPESGA-Cas9-ERT2 |
| 28 | 16 | NLS-TGGGS-ERT2-SGSEGA-Cas9-ERT2 |
| 29 | 7 | NLS-TGGGS-ERT2-SGSETPGTGA-Cas9-ERT2 |
| 30 | 12 | NLS-TGGGS-ERT2-SGSETPGTSEGA-Cas9-ERT2 |
| 31 | 22 | NLS-TGGGS-ERT2-PRGGS-ERT2-TPESGA-Cas9-ERT2 |
| 32 | 21 | NLS-TGGGS-ERT2-GGSPRGGS-ERT2-TPESGA-Cas9-ERT2 |
| 33 | 23 | NLS-TG-ERT2-GA-Cas9-ERT2-PAG-ERT2 |
| 34 | 24 | NLS-TG-ERT2-GA-Cas9-ERT2-PAGGGS-ERT2 |
| 35 | 8 | NLS-TGGGS-ERT2-SGSETPGTPGGA-Cas9-ERT2 |
| 36 | 27 | NLS-TGGGS-ERT2-PRGGS-ERT2-TPESGA-Cas9-ERT2-PAG-ERT2 |
| 37 | 30 | NLS-TGGGS-ERT2-PR-ERT2-TPESGA-Cas9-ERT2-PAGGGS-ERT2 |
| 38 | 25 | NLS-TG-ERT2-GGSPRGGS-ERT2-TPESGA-Cas9-ERT2-PAGGGS-ERT2 |
| 39 | 28 | NLS-TGGGS-ERT2-TPGGPRGGS-ERT2-TPESGA-Cas9-ERT2-PAG-ERT2 |
| 40 | 26 | NLS-TGGGS-ERT2-TPGGPRGGS-ERT2-TPESGA-Cas9-ERT2-PAGGGS-ERT2 |
| 41 | 10 | NLS-TG-ERT2-TPESGPGGA-Cas9-ERT2 |
| 42 | 20 | NLS-TG-ERT2-GGSPRGGS-ERT2-TPESGA-Cas9-ERT2 |
| 43 | 29 | NLS-TG-ERT2-GGSPRGGS-ERT2-TPESGA-Cas9-ERT2-PAG-ERT2 |
| 44 | 18 | NLS-TG-ERT2-GASGS-Cas9-ERT2 |

SEQUENCE LISTING (399 sequences)

SEQ ID NO: 1 - protein, 1367 aa, Artificial sequence
  SpCas9
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 2 - protein, 1307 aa, Artificial sequence
  AsCpf1
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 3 - protein, 1228 aa, Artificial sequence
  LbCpf1
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 4 - protein, 313 aa, Artificial sequence
  ERT2
AGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 5 - protein, 16 aa, Artificial sequence
  NLS
APKKKRKVGIHGVPAA

SEQ ID NO: 6 - protein, 11 aa, Artificial sequence
  NLS
SRADPKKKRKV

SEQ ID NO: 7 - protein, 48 aa, Artificial sequence
  MLS
LGFVGRVAAAPASGALRRLTPSASLPPAQLLLRAAPTAVHPVRDYAAQ

SEQ ID NO: 8 - protein, 29 aa, Artificial sequence
  MLS
LSRAVCGTSRQLAPVLGYLGSRQKHSLPD

SEQ ID NO: 9 - protein, 28 aa, Artificial sequence
  MLS
SVLTPLLLRGLTGSARRLPVPRAKIHSL

SEQ ID NO: 10 - protein, 31 aa, Artificial sequence
  MLS
LFNLRILLNNAAFRNGHNFMVRNFRCGQPLQ

SEQ ID NO: 11 - protein, 41 aa, Artificial sequence
  MLS
AFLRSMWGVLSALGRSGAELCTGCGSRLRSPFSFVYLPRWF

SEQ ID NO: 12 - protein, 14 aa, Artificial sequence
  V5
GKPIPNPLLGLDST

SEQ ID NO: 13 - protein, 23 aa, Artificial sequence
  2A
SRGSGEGRGSLLTCGDVEENPGP

SEQ ID NO: 14 - protein, 225 aa, Artificial sequence
  OFP
MNLSKNVSVSVYMKGNVNNHEFEYDGEGGGDPYTGKYSMKMTLRGQNSLPFSYDIITTAFQYGFRVFTKYPEGIVDYFKDSLPDAFQWNRRIVFEDGGVLNMSSDITYKDNVLHGDVKAEGVNFPPNGPVMKNEIVMEEPTEETFTPKNGVLVGFCPKAYLLKDGSYYYGNMTTFYRSKKSGQAPPGYHFVKHRLVKTNVGHGFKTVEQTEYATAHVSDLPKFEA

SEQ ID NO: 15 - protein, 2013 aa, Artificial sequence
  Cas9 variant 17 linkers
APKKKRKVGIHGVPAAPRAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 16 - protein, 2017 aa, Artificial sequence
  Cas9 variant 2 linkers
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSEGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 17 - protein, 2020 aa, Artificial sequence
  Cas9 variant 9 linkers
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGASGSKTPGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 18 - protein, 2025 aa, Artificial sequence
  Cas9 variant 1 linkers
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTSESAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 19 - protein, 2024 aa, Artificial sequence
  Cas9 variant 5 linkers
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTGPGGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 20 - protein, 2021 aa, Artificial sequence
  Cas9 variant 6 linkers
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASESATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 21 - protein, 2024 aa, Artificial sequence
  Cas9 variant 4 linkers
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGTSESATPESGGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 22 - protein, 2019 aa, Artificial sequence
  Cas9 variant 3 linkers
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSGGSGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 23 - protein, 2019 aa, Artificial sequence
  Cas9 variant 11 linkers
APKKKRKVGIHGVPAATGPGPGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 24 - protein, 2031 aa, Artificial sequence
  Cas9 variant 14 linkers
APKKKRKVGIHGVPAATGPGPGGSAGDTTGPGTGPGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 25 - protein, 2017 aa, Artificial sequence
  Cas9 variant 19 linkers
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 26 - protein, 2020 aa, Artificial sequence
  Cas9 variant 13 linkers
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 27 - protein, 2024 aa, Artificial sequence
  Cas9 variant 15 linkers
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASESATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 28 - protein, 2020 aa, Artificial sequence
  Cas9 variant 16 linkers
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSEGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 29 - protein, 2024 aa, Artificial sequence
  Cas9 variant 7 linkers
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 30 - protein, 2026 aa, Artificial sequence
  Cas9 variant 12 linkers
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTSEGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 31 - protein, 2338 aa, Artificial sequence
  Cas9 variant 22 linkers
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 32 - protein, 2341 aa, Artificial sequence
  Cas9 variant 21 linkers
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 33 - protein, 2329 aa, Artificial sequence
  Cas9 variant 23 linkers
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 34 - protein, 2332 aa, Artificial sequence
  Cas9 variant 24 linkers
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 35 - protein, 2026 aa, Artificial sequence
  Cas9 variant 8 linkers
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTPGGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 36 - protein, 2654 aa, Artificial sequence
  Cas9 variant 27 linkers
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 37 - protein, 2654 aa, Artificial sequence
  Cas9 variant 30 linkers (iCas)
  misc_feature (2022)..(2022): Xaa can be any naturally occurring amino acid
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPRAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 38 - protein, 2657 aa, Artificial sequence
  Cas9 variant 25 linkers
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 39 - protein, 2658 aa, Artificial sequence
  Cas9 variant 28 linkers
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPGGPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 40 - protein, 2661 aa, Artificial sequence
  Cas9 variant 26 linkers
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPGGPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 41 - protein, 2020 aa, Artificial sequence
  Cas9 variant 10 linkers
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGPGGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 42 - protein, 2338 aa, Artificial sequence
  Cas9 variant 20 linkers
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 43 - protein, 2654 aa, Artificial sequence
  Cas9 variant 29 linkers
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 44 - protein, 2016 aa, Artificial sequence
  Cas9 variant 18 linkers
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGASGSDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 45 - DNA, 6906 bp, Artificial Sequence
  cloned, variant sequence 1
atgggcaagcccatccctaaccccctgttggggctggacagcaccgctcccaaaaagaaaaggaaggtgggcattcacggcgtgcctgcggccaccggtgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctagcggcagcgagactcccgggacctcagagtccgccggcgccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 46 - DNA, 6882 bp, Artificial sequence
  cloned, variant sequence 2
atgggcaagcccatccctaaccccctgttggggctggacagcaccgctcccaaaaagaaaaggaaggtgggcattcacggcgtgcctgcggccaccggtgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggatctgaaggcgccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 47 - DNA, 6888 bp, Artificial sequence
  cloned, variant sequence 3
atgggcaagcccatccctaaccccctgttggggctggacagcaccgctcccaaaaagaaaaggaaggtgggcattcacggcgtgcctgcggccaccggtgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctggtggctctggaggtagcggcgccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 48 - DNA, 6903 bp, Artificial sequence
  cloned, variant sequence 4
atgggcaagcccatccctaaccccctgttggggctggacagcaccgctcccaaaaagaaaaggaaggtgggcattcacggcgtgcctgcggccaccggtgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctgggacctcagagtccgccacaccagaatcgggcggcgccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 49 - DNA, 6894 bp, Artificial sequence
  cloned, variant sequence 5
atgggcaagcccatccctaaccccctgttggggctggacagcaccgctcccaaaaagaaaaggaaggtgggcattcacggcgtgcctgcggccaccggtgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggatctgaaactcccgggaccggcgccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 50 - DNA, 6894 bp, Artificial sequence
  cloned, variant sequence 6
atgggcaagcccatccctaaccccctgttggggctggacagcaccgctcccaaaaagaaaaggaaggtgggcattcacggcgtgcctgcggccaccggtgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttcagagtccgccacaccagaatcgggcgccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 51 - DNA, 6903 bp, Artificial sequence
  cloned, variant sequence 7
atgggcaagcccatccctaaccccctgttggggctggacagcaccgctcccaaaaagaaaaggaaggtgggcattcacggcgtgcctgcggccaccggtggaggatctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggatctgaaactcccgggaccggcgccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 52 - DNA, 6909 bp, Artificial sequence
  cloned, variant sequence 8
atgggcaagcccatccctaaccccctgttggggctggacagcaccgctcccaaaaagaaaaggaaggtgggcattcacggcgtgcctgcggccaccggtggaggctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggatctgaaactcccgggacccccgggggcgccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 53 - DNA, 6891 bp, Artificial sequence
  cloned, variant sequence 9
atgggcaagcccatccctaaccccctgttggggctggacagcaccgctcccaaaaagaaaaggaaggtgggcattcacggcgtgcctgcggccaccggtgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctggcgccagcggcagcaagactcccggggacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 54 - DNA, 6882 bp, Artificial sequence
  cloned, variant sequence 10
atgggcaagcccatccctaaccccctgttggggctggacagcaccgctcccaaaaagaaaaggaaggtgggcattcacggcgtgcctgcggccaccggtgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctacaccagaatcgggcgccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 55 - DNA, 6882 bp, Artificial sequence
  cloned, variant sequence 11
atgggcaagcccatccctaaccccctgttggggctggacagcaccgctcccaaaaagaaaaggaaggtgggcattcacggcgtgcctgcggccaccggtcccgggggttccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctggcgccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 56 - DNA, 6909 bp, Artificial sequence
  cloned, variant sequence 12
atgggcaagcccatccctaaccccctgttggggctggacagcaccgctcccaaaaagaaaaggaaggtgggcattcacggcgtgcctgcggccaccggtggaggctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggatctgaaactcccgggacctcagagggcgccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 57 - DNA, 6891 bp, Artificial sequence
  cloned, variant sequence 13
atgggcaagcccatccctaaccccctgttggggctggacagcaccgctcccaaaaagaaaaggaaggtgggcattcacggcgtgcctgcggccaccggtggaggctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctacaccagaatcgggcgccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 58 - DNA, 6912 bp, Artificial sequence
  cloned, variant sequence 14
atgggcaagcccatccctaaccccctgttggggctggacagcaccgctcccaaaaagaaaaggaaggtgggcattcacggcgtgcctgcggccaccggtcccgggggttccgctggagacaccaccggtcccgggggttccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctggcgccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 59 - DNA, 6903 bp, Artificial sequence
  cloned, variant sequence 15
atgggcaagcccatccctaaccccctgttggggctggacagcaccgctcccaaaaagaaaaggaaggtgggcattcacggcgtgcctgcggccaccggtggaggatctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttcagagtccgccacaccagaatcgggcgccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 60 - DNA, 6891 bp, Artificial sequence
  cloned, variant sequence 16
atgggcaagcccatccctaaccccctgttggggctggacagcaccgctcccaaaaagaaaaggaaggtgggcattcacggcgtgcctgcggccaccggtggaggatctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggatctgaaggcgccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 61 - DNA, 6870 bp, Artificial sequence
  cloned, variant sequence 17
atgggcaagcccatccctaaccccctgttggggctggacagcaccgctcccaaaaagaaaaggaaggtgggcattcacggcgtgcctgcggccaccggtgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccggggacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 62 - DNA, 6879 bp, Artificial sequence
  cloned, variant sequence 18
atgggcaagcccatccctaaccccctgttggggctggacagcaccgctcccaaaaagaaaaggaaggtgggcattcacggcgtgcctgcggccaccggtgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctggcgccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtgtccggatctgaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 63 - DNA, 6882 bp, Artificial sequence
  cloned, variant sequence 19
atgggcaagcccatccctaaccccctgttggggctggacagcaccgctcccaaaaagaaaaggaaggtgggcattcacggcgtgcctgcggccaccggtgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctggcgccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcggcggtggatccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 64 - DNA, 7845 bp, Artificial sequence
  cloned, variant sequence 20
atgggcaagcccatccctaaccccctgttggggctggacagcaccgctcccaaaaagaaaaggaaggtgggcattcacggcgtgcctgcggccaccggtgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctggtggaagtcctaggggaggctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctacaccagaatcgggcgccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 65 - DNA, 7854 bp, Artificial sequence
  cloned, variant sequence 21
atgggcaagcccatccctaaccccctgttggggctggacagcaccgctcccaaaaagaaaaggaaggtgggcattcacggcgtgcctgcggccaccggtggaggctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctggtggaagtcctaggggaggctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctacaccagaatcgggcgccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 66 - DNA, 7845 bp, Artificial sequence
  cloned, variant sequence 22
atgggcaagcccatccctaaccccctgttggggctggacagcaccgctcccaaaaagaaaaggaaggtgggcattcacggcgtgcctgcggccaccggtggaggctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcctaggggaggttctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctacaccagaatcgggcgccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 67 - DNA, 7818 bp, Artificial sequence
  cloned, variant sequence 23
atgggcaagcccatccctaaccccctgttggggctggacagcaccgctcccaaaaagaaaaggaaggtgggcattcacggcgtgcctgcggccaccggtgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctggcgccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcctgcaggtgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 68 - DNA, 7827 bp, Artificial sequence
  cloned, variant sequence 24
atgggcaagcccatccctaaccccctgttggggctggacagcaccgctcccaaaaagaaaaggaaggtgggcattcacggcgtgcctgcggccaccggtgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctggcgccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcctgcaggtggaggctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 69 - DNA, 8808 bp, Artificial sequence
  cloned, variant sequence 25
atgggcaagcccatccctaaccccctgttggggctggacagcaccgctcccaaaaagaaaaggaaggtgggcattcacggcgtgcctgcggccaccggtgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctggtggaagtcctaggggaggctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctacaccagaatcgggcgccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcctgcaggtggaggctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagatctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 70 - DNA, 8811 bp, Artificial sequence
  cloned, variant sequence 26
atgggcaagcccatccctaaccccctgttggggctggacagcaccgctcccaaaaagaaaaggaaggtgggcattcacggcgtgcctgcggccaccggtggaggctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctggtggaagtcctaggggaggttctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctacaccagaatcgggcgccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcctgcaggtggaggctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 71 - DNA, 8793 bp, Artificial sequence
  cloned, variant sequence 27
atgggcaagcccatccctaaccccctgttggggctggacagcaccgctcccaaaaagaaaaggaaggtgggcattcacggcgtgcctgcggccaccggtggaggctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcctaggggaggttctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctacaccagaatcgggcgccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcctgcaggtgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 72 - DNA, 8802 bp, Artificial sequence
  cloned, variant sequence 28
atgggcaagcccatccctaaccccctgttggggctggacagcaccgctcccaaaaagaaaaggaaggtgggcattcacggcgtgcctgcggccaccggtggaggctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctggtggaagtcctaggggaggttctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctacaccagaatcgggcgccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcctgcaggtgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 73 - DNA, 8799 bp, Artificial sequence
  cloned, variant sequence 29
atgggcaagcccatccctaaccccctgttggggctggacagcaccgctcccaaaaagaaaaggaaggtgggcattcacggcgtgcctgcggccaccggtgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctggtggaagtcctaggggaggctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctacaccagaatcgggcgccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcctgcaggtgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagatctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 74 - DNA, 8802 bp, Artificial sequence
  cloned, variant sequence 30
atgggcaagcccatccctaaccccctgttggggctggacagcaccgctcccaaaaagaaaaggaaggtgggcattcacggcgtgcctgcggccaccggtggaggctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcctaggggaggctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctacaccagaatcgggcgccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattcgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcctgcaggtggaggctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttcttgaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttctagaggcagtggagagggcagaggaagtctgctaacatgcggtgacgtcgaggagaatcctggcccaatgaacctgagcaaaaacgtgagcgtgagcgtgtatatgaaggggaacgtcaacaatcatgagtttgagtacgacggggaaggtggtggtgatccttatacaggtaaatattccatgaagatgacgctacgtggtcaaaattccctacccttttcctatgatatcattaccacggcatttcagtatggtttccgcgtatttacaaaataccctgagggaattgttgactattttaaggactcgcttcccgacgcattccagtggaacagacgaattgtgtttgaagatggtggagtactaaacatgagcagtgatatcacatataaagataatgttctgcatggtgacgtcaaggctgagggagtgaacttcccgccgaatgggccagtgatgaagaatgaaattgtgatggaggaaccgactgaagaaacatttactccaaaaaacggggttcttgttggcttttgtcccaaagcgtacttacttaaagacggttcctattactatggaaatatgacaacattttacagatccaagaaatctggccaggcacctcctgggtatcactttgttaagcatcgtctcgtcaagaccaatgtgggacatggatttaagacggttgagcagactgaatatgccactgctcatgtcagtgatcttcccaagttcgaagcttga

SEQ ID NO: 75 - DNA, 23 bp, Artificial sequence
  EMX1; Chr2: 73160982; On
gagtccgagcagaagaagaaggg

SEQ ID NO: 76 - DNA, 23 bp, Artificial sequence
  EMX1; Chr5: 45359083; Off 1
gagttagagcagaagaagaaagg

SEQ ID NO: 77 - DNA, 23 bp, Artificial sequence
  EMX1; Chr15: 44109747; Off 2
gagtctaagcagaagaagaagag

SEQ ID NO: 78 - DNA, 23 bp, Artificial sequence
  VEGFA P1; Chr6: 43737313; On
gggtggggggagtttgctcctgg

SEQ ID NO: 79 - DNA, 23 bp, Artificial sequence
  VEGFA P1; Chr15: 65637553; Off 1
ggatggagggagtttgctcctgg

SEQ ID NO: 80 - DNA, 23 bp, Artificial sequence
  VEGFA P1; Chr17: 39796344; Off 2
tagtggagggagcttgctcctgg

SEQ ID NO: 81 - DNA, 23 bp, Artificial sequence
  VEGFA P1; Chr1: 99347667; Off 3
ggggaggggaagtttgctcctgg

SEQ ID NO: 82 - DNA, 23 bp, Artificial sequence
  VEGFA P2; Chr6: 43737454; On
ggtgagtgagtgtgtgcgtgtgg

SEQ ID NO: 83 - DNA, 23 bp, Artificial sequence
  VEGFA P2; Chr9: 16681608; Off 1
agtgagtgagtgtgtgtgtgggg

SEQ ID NO: 84 - DNA, 23 bp, Artificial sequence
  VEGFA P2;Chr5: 89440985; Off 2
agagagtgagtgtgtgcatgagg

SEQ ID NO: 85 - DNA, 23 bp, Artificial sequence
  VEGFA P2; Chr5: 115434659; Off 3
tgtgggtgagtgtgtgcgtgagg

SEQ ID NO: 86 - DNA, 23 bp, Artificial sequence
  VEGFA P2; Chr22: 37662840; Off 4
gctgagtgagtgtatgcgtgtgg

SEQ ID NO: 87 - DNA, 23 bp, Artificial sequence
  WAS I1; ChrX: 48544569; On
tggatggaggaatgaggagttgg

SEQ ID NO: 88 - DNA, 23 bp, Artificial sequence
  WAS I1; Chr1: 30597854; Off 1
tggatggagggatgaggagtggg

SEQ ID NO: 89 - DNA, 23 bp, Artificial sequence
  WAS I1; Chr2: 242451414; Off 2
gggatggagggatgaggagtggg

SEQ ID NO: 90 - DNA, 23 bp, Artificial sequence
  WAS I1, Chr18: 21810215, Off 3
aggagggaggaatggggagttgg

SEQ ID NO: 91 - DNA, 23 bp, Artificial sequence
  WAS I2, ChrX: 48544562, On
cccatccatccagagacacaggg

SEQ ID NO: 92 - DNA, 23 bp, Artificial sequence
  WAS I2; ChrX: 90817748; Off 1
ctcttccacccagagacacaggg

SEQ ID NO: 93 - DNA, 23 bp, Artificial sequence
  TAT; Chr16: 71609818; On
tcctcctgagactccatacctgg

SEQ ID NO: 94 - DNA, 23 bp, Artificial sequence
  TAT; Chr6: 12810776; Off 1
ccatcctgagactccatacctgg

SEQ ID NO: 95 - DNA, 23 bp, Artificial sequence
  FANCF; Chr11: 22647354; On
ggaatcccttctgcagcacctgg

SEQ ID NO: 96 - DNA, 23 bp, Artificial sequence
  FANCF; Chr18: 8707544; Off 1
ggaaccccgtctgcagcaccagg

SEQ ID NO: 97 - DNA, 23 bp, Artificial sequence
  FANCF; Chr10: 43410014; Off 2
ggagtccctcctacagcaccagg

SEQ ID NO: 98 - DNA, 23 bp, Artificial sequence
  FANCF; Chr10: 37953183; Off 3
ggagtccctcctacagcaccagg

SEQ ID NO: 99 - DNA, 23 bp, Artificial sequence
  FANCF; Chr17: 78923961; Off 4
agaggcccctctgcagcaccagg

SEQ ID NO: 100 - DNA, 20 bp, Artificial sequence
  EMX1_On_Set1_FOR
gcccctaaccctatgtagcc

SEQ ID NO: 101 - DNA, 20 bp, Artificial sequence
  EMX1_On_Set1_REV
ggagattggagacacggaga

SEQ ID NO: 102 - DNA, 20 bp, Artificial sequence
  EMX1_On_Set2_FOR
ctgtgtcctcttcctgccct

SEQ ID NO: 103 - DNA, 20 bp, Artificial sequence
  EMX1_On_Set2_REV
ctctccgaggagaaggccaa

SEQ ID NO: 104 - DNA, 22 bp, Artificial sequence
  EMX1_Off1_FOR
ttgagacatggggatagaatca

SEQ ID NO: 105 - DNA, 22 bp, Artificial sequence
  EMX1_Off1_REV
caggaatagccctacaaaggtg

SEQ ID NO: 106 - DNA, 20 bp, Artificial sequence
  EMX1_Off2_FOR
gttctgtaaacgccgtagcc

SEQ ID NO: 107 - DNA, 20 bp, Artificial sequence
  EMX1_Off2_REV
ggatgcagtctgcctttttg

SEQ ID NO: 108 - DNA, 20 bp, Artificial sequence
  PPP1R12C_On_Set1_FOR
gtctaacccccacctcctgt

SEQ ID NO: 109 - DNA, 20 bp, Artificial sequence
  PPP1R12C_On_Set1_REV
acacctaggacgcaccattc

SEQ ID NO: 110 - DNA, 20 bp, Artificial sequence
  PPP1R12C_On_Set2_FOR
cggttaatgtggctctggtt

SEQ ID NO: 111 - DNA, 21 bp, Artificial sequence
  PPP1R12C_On_Set2_REV
cgcacggaggaacaatataaa

SEQ ID NO: 112 - DNA, 20 bp, Artificial sequence
  VEGFA_Promoter1_On_Set1_FOR
ctggacacttcccaaaggac

SEQ ID NO: 113 - DNA, 20 bp, Artificial sequence
  VEGFA_Promoter1_On_Set1_REV
agggagcaggaaagtgaggt

SEQ ID NO: 114 - DNA, 20 bp, Artificial sequence
  VEGFA_Promoter1_On_Set2_FOR
tcactgactaaccccggaac

SEQ ID NO: 115 - DNA, 20 bp, Artificial sequence
  VEGFA_Promoter1_On_Set2_REV
ctgagagccgttccctcttt

SEQ ID NO: 116 - DNA, 21 bp, Artificial sequence
  VEGFA_Promoter1_Off1_FOR
gggctagagtgtagtggcaca

SEQ ID NO: 117 - DNA, 21 bp, Artificial sequence
  VEGFA_Promoter1_Off1_REV
gccctgttttcatcctacaca

SEQ ID NO: 118 - DNA, 20 bp, Artificial sequence
  VEGFA_Promoter1_Off2_FOR
aagttgggcaagagtccaga

SEQ ID NO: 119 - DNA, 20 bp, Artificial sequence
  VEGFA_Promoter1_Off2_REV
accagcagaggaagggctat

SEQ ID NO: 120 - DNA, 20 bp, Artificial sequence
  VEGFA_Promoter1_Off3_FOR
tgccatttttaagccatcag

SEQ ID NO: 121 - DNA, 20 bp, Artificial sequence
  VEGFA_Promoter1_Off3_REV
agcccattctttttgcagtg

SEQ ID NO: 122 - DNA, 20 bp, Artificial sequence
  VEGFA_Promoter2_On_FOR
ccagatggcacattgtcaga

SEQ ID NO: 123 - DNA, 20 bp, Artificial sequence
  VEGFA_Promoter2_On_REV
ccaaggttcacagcctgaaa

SEQ ID NO: 124 - DNA, 20 bp, Artificial sequence
  VEGFA_Promoter2_Off1_FOR
gccgtctgttagagggacaa

SEQ ID NO: 125 - DNA, 20 bp, Artificial sequence
  VEGFA_Promoter2_Off1_REV
gtcttcccccaacctccagt

SEQ ID NO: 126 - DNA, 22 bp, Artificial sequence
  VEGFA_Promoter2_Off2_FOR
ggcccaatcttagtgtttcaga

SEQ ID NO: 127 - DNA, 22 bp, Artificial sequence
  VEGFA_Promoter2_Off2_REV
tggttaaaagcaaaggatgtga

SEQ ID NO: 128 - DNA, 22 bp, Artificial sequence
  VEGFA_Promoter2_Off3_FOR
ccctcgctagatactgaggaaa

SEQ ID NO: 129 - DNA, 21 bp, Artificial sequence
  VEGFA_Promoter2_Off3_REV
tggccaagataaggaaacaac

SEQ ID NO: 130 - DNA, 20 bp, Artificial sequence
  VEGFA_Promoter2_Off4_FOR
tgattccgctgacacgtaac

SEQ ID NO: 131 - DNA, 20 bp, Artificial sequence
  VEGFA_Promoter2_Off4_REV
ttcagagcctctcaccacct

SEQ ID NO: 132 - DNA, 20 bp, Artificial sequence
  WAS_Intron1-2_On_Set1_FOR
cagccaatgaaggtgagtcc

SEQ ID NO: 133 - DNA, 20 bp, Artificial sequence
  WAS_Intron1-2_On_Set1_REV
gtggatcccacaaaccattc

SEQ ID NO: 134 - DNA, 20 bp, Artificial sequence
  WAS_Intron1-2_On_Set2_FOR
aggaatcagaggcaaagtgg

SEQ ID NO: 135 - DNA, 20 bp, Artificial sequence
  WAS_Intron1-2_On_Set2_REV
tcccatcaattcatccctct

SEQ ID NO: 136 - DNA, 20 bp, Artificial sequence
  WAS_Intron1_Off1_FOR
ctgtcctctctgcaggaacc

SEQ ID NO: 137 - DNA, 20 bp, Artificial sequence
  WAS_Intron1_Off1_REV
gtctggatccctgcatcact

SEQ ID NO: 138 - DNA, 20 bp, Artificial sequence
  WAS_Intron1_Off2_FOR
cgaggttccagaatgctctt

SEQ ID NO: 139 - DNA, 20 bp, Artificial sequence
  WAS_Intron1_Off2_REV
gggaggctaaaccctgaaac

SEQ ID NO: 140 - DNA, 20 bp, Artificial sequence
  WAS_Intron1_Off3_FOR
tcttcaatgttcccccacat

SEQ ID NO: 141 - DNA, 20 bp, Artificial sequence
  WAS_Intron1_Off3_REV
aggctgccattgtctgaagt

SEQ ID NO: 142 - DNA, 23 bp, Artificial sequence
  WAS_Intron2_Off1_Set1_FOR
tctcagagatacaagggaaatcg

SEQ ID NO: 143 - DNA, 23 bp, Artificial sequence
  WAS_Intron2_Off1_Set1_REV
ccagcagactctgggtctattta

SEQ ID NO: 144 - DNA, 21 bp, Artificial sequence
  WAS_Intron2_Off1_Set2_FOR
tacaagggaaatcgtgagacc

SEQ ID NO: 145 - DNA, 21 bp, Artificial sequence
  WAS_Intron2_Off1_Set2_REV
agtcagcatgcagattctggt

SEQ ID NO: 146 - DNA, 22 bp, Artificial sequence
  TAT_On_FOR
gacaacatgaaggtgaaaccaa

SEQ ID NO: 147 - DNA, 22 bp, Artificial sequence
  TAT_On_REV
gtcaaagaaagccaggaaagaa

SEQ ID NO: 148 - DNA, 20 bp, Artificial sequence
  TAT_Off1_FOR
tgtggttggttggtttgttg

SEQ ID NO: 149 - DNA, 20 bp, Artificial sequence
  TAT_Off1_REV
gtgaccaagcaggctctttc

SEQ ID NO: 150 - DNA, 20 bp, Artificial sequence
  FANCF_On_FOR
acctctttgtgtggcgaaag

SEQ ID NO: 151 - DNA, 20 bp, Artificial sequence
  FANCF_On_REV
ccaggctctcttggagtgtc

SEQ ID NO: 152 - DNA, 20 bp, Artificial sequence
  FANCF_Off1_FOR
cagacttcaccaccatgcac

SEQ ID NO: 153 - DNA, 20 bp, Artificial sequence
  FANCF_Off1_REV
ggccagtcctttgtaagcat

SEQ ID NO: 154 - DNA, 22 bp, Artificial sequence
  FANCF_Off2_FOR
aatgtaagaggcaaccaaagga

SEQ ID NO: 155 - DNA, 22 bp, Artificial sequence
  FANCF_Off2_REV
gttaatggaaggtgaaggcagt

SEQ ID NO: 156 - DNA, 21 bp, Artificial sequence
  FANCF_Off3_FOR
aatgcaagaggcaaacaaaaa

SEQ ID NO: 157 - DNA, 21 bp, Artificial sequence
  FANCF_Off3_REV
ccaacatcttcacaagggttc

SEQ ID NO: 158 - DNA, 20 bp, Artificial sequence
  FANCF_Off4_FOR
caaccttcatccttggcttg

SEQ ID NO: 159 - DNA, 21 bp, Artificial sequence
  FANCF_Off4_REV
gagacagagccatgcaaccta

SEQ ID NO: 160 - DNA, 20 bp, Artificial sequence
  CTNNB1_On_FOR
gccaccagcaggaatctagt

SEQ ID NO: 161 - DNA, 23 bp, Artificial sequence
  CTNNB1_On_REV
tcaaaactgcattctgactttca

SEQ ID NO: 162 - DNA, 20 bp, Artificial sequence
  ADAR1_On_FOR
gggcaggaacctgtcataaa

SEQ ID NO: 163 - DNA, 20 bp, Artificial sequence
  ADAR1_On_REV
cccttgttcagccaagattc

SEQ ID NO: 164 - DNA, 21 bp, Artificial sequence
  TCF7_On_FOR
ttccttcccaagtcaggaact

SEQ ID NO: 165 - DNA, 21 bp, Artificial sequence
  TCF7_On_REV
tatgggagaaaagaccagcac

SEQ ID NO: 166 - DNA, 20 bp, Artificial sequence
  PARP4_On_FOR
ggacttccagctttttgcac

SEQ ID NO: 167 - DNA, 20 bp, Artificial sequence
  PARP4_On_REV
ttgctctcgggattttagga

SEQ ID NO: 168 - DNA, 19 bp, Artificial sequence
  ASXL2_On_FOR
catggcagcccctttctat

SEQ ID NO: 169 - DNA, 20 bp, Artificial sequence
  ASXL2_On_REV
gcctggccataagtcatttt

SEQ ID NO: 170 - DNA, 34 bp, Artificial sequence
  EMX1_On_Adapter_FOR
gcgttatcgaggtcgggcctcctgagtttctcat

SEQ ID NO: 171 - DNA, 34 bp, Artificial sequence
  EMX1_On_Adapter_REV
gtgctcttccgatctgtggttgcccaccctagtc

SEQ ID NO: 172 - DNA, 38 bp, Artificial sequence
  EMX1_Off1_Adapter_FOR
gcgttatcgaggtctgcacatgtatgtacaggagtcat

SEQ ID NO: 173 - DNA, 40 bp, Artificial sequence
  EMX1_Off1_Adapter_REV
gtgctcttccgatctcaccttttaagatctgacagagaaa

SEQ ID NO: 174 - DNA, 36 bp, Artificial sequence
  EMX1_Off2_Adapter_FOR
gcgttatcgaggtctgggcgagaaaggtaacttatg

SEQ ID NO: 175 - DNA, 37 bp, Artificial sequence
  EMX1_Off2_Adapter_REV
gtgctcttccgatctactgtttcactgcctaccttcc

SEQ ID NO: 176 - DNA, 34 bp, Artificial sequence
  PPP1R12C_On_Adapter_Set1_FOR
gcgttatcgaggtcgatcagtgaaacgcaccaga

SEQ ID NO: 177 - DNA, 35 bp, Artificial sequence
  PPP1R12C_On_Adapter_Set1_REV
gtgctcttccgatctgtctaacccccacctcctgt

SEQ ID NO: 178 - DNA, 35 bp, Artificial sequence
  PPP1R12C_On_Adapter_Set2_FOR
gcgttatcgaggtcgtcagagcagctcaggttctg

SEQ ID NO: 179 - DNA, 37 bp, Artificial sequence
  PPP1R12C_On_Adapter_Set2_REV
gtgctcttccgatcttaggcctcctccttcctagtct

SEQ ID NO: 180 - DNA, 34 bp, Artificial sequence
  VEGFA_Promoter1_On_Adapter_FOR
gcgttatcgaggtcgcacattgtcagagggacac

SEQ ID NO: 181 - DNA, 35 bp, Artificial sequence
  VEGFA_Promoter1_On_Adapter_REV
gtgctcttccgatctcacacgtcctcactctcgaa

SEQ ID NO: 182 - DNA, 34 bp, Artificial sequence
  VEGFA_Promoter1_Off1_Adapter_FOR
gcgttatcgaggtctctcaaactcctgggctcaa

SEQ ID NO: 183 - DNA, 35 bp, Artificial sequence
  VEGFA_Promoter1_Off1_Adapter_REV
gtgctcttccgatctctggtttttggtttgggaaa

SEQ ID NO: 184 - DNA, 34 bp, Artificial sequence
  VEGFA_Promoter1_Off2_Adapter_FOR
gcgttatcgaggtcccctctccatgaaactttgc

SEQ ID NO: 185 - DNA, 35 bp, Artificial sequence
  VEGFA_Promoter1_Off2_Adapter_REV
gtgctcttccgatctagggcaaaacaggagaacag

SEQ ID NO: 186 - DNA, 34 bp, Artificial sequence
  VEGFA_Promoter1_Off3_Adapter_FOR
gcgttatcgaggtcgcatctctgccttcattgct

SEQ ID NO: 187 - DNA, 35 bp, Artificial sequence
  VEGFA_Promoter1_Off3_Adapter_REV
gtgctcttccgatctgcctactccagggtttctca

SEQ ID NO: 188 - DNA, 33 bp, Artificial sequence
  VEGFA_Promoter2_On_Adapter_FOR
gcgttatcgaggtcgcagacggcagtcactagg

SEQ ID NO: 189 - DNA, 34 bp, Artificial sequence
  VEGFA_Promoter2_On_Adapter_REV
gtgctcttccgatctccgttccctctttgctagg

SEQ ID NO: 190 - DNA, 32 bp, Artificial sequence
  VEGFA_Promoter2_Off1_Adapter_FOR
gcgttatcgaggtcgatccggtgctgcagtga

SEQ ID NO: 191 - DNA, 34 bp, Artificial sequence
  VEGFA_Promoter2_Off1_Adapter_REV
gtgctcttccgatctgctctccacctcgatgtca

SEQ ID NO: 192 - DNA, 34 bp, Artificial sequence
  VEGFA_Promoter2_Off2_Adapter_FOR
gcgttatcgaggtctcaaagtttcacatggttgc

SEQ ID NO: 193 - DNA, 33 bp, Artificial sequence
  VEGFA_Promoter2_Off2_Adapter_REV
gtgctcttccgatctgtgtggagggtgggacct

SEQ ID NO: 194 - DNA, 36 bp, Artificial sequence
  VEGFA_Promoter2_Off3_Adapter_FOR
gcgttatcgaggtcattatgcgtattcagggtgtgc

SEQ ID NO: 195 - DNA, 38 bp, Artificial sequence
  VEGFA_Promoter2_Off3_Adapter_REV
gtgctcttccgatctgctggtcagagggtacaactttt

SEQ ID NO: 196 - DNA, 35 bp, Artificial sequence
  VEGFA_Promoter2_Off4_Adapter_FOR
gcgttatcgaggtcggttaggagagctggcttgga

SEQ ID NO: 197 - DNA, 32 bp, Artificial sequence
  VEGFA_Promoter2_Off4_Adapter_REV
gtgctcttccgatctctggcctcggcctctca

SEQ ID NO: 198 - DNA, 34 bp, Artificial sequence
  WAS_Intron1-2_On_Adapter_FOR
gcgttatcgaggtcggcagggctgtgataactct

SEQ ID NO: 199 - DNA, 34 bp, Artificial sequence
  WAS_Intron1-2_On_Adapter_REV
gtgctcttccgatctatctaccgccaatccatcc

SEQ ID NO: 200 - DNA, 35 bp, Artificial sequence
  WAS_Intron1_Off1_Adapter_FOR
gcgttatcgaggtcacggcatggaattatttggtt

SEQ ID NO: 201 - DNA, 36 bp, Artificial sequence
  WAS_Intron1_Off1_Adapter_REV
gtgctcttccgatctgcctgggagagaaatcaactc

SEQ ID NO: 202 - DNA, 36 bp, Artificial sequence
  WAS_Intron1_Off2_Adapter_FOR
gcgttatcgaggtcactgtgtaggaagcccactctc

SEQ ID NO: 203 - DNA, 37 bp, Artificial sequence
  WAS_Intron1_Off2_Adapter_REV
gtgctcttccgatctaaagcttggtgacagtgaaatg

SEQ ID NO: 204 - DNA, 34 bp, Artificial sequence
  WAS_Intron1_Off3_Adapter_FOR
gcgttatcgaggtccatgaagggaagaggtgcat

SEQ ID NO: 205 - DNA, 35 bp, Artificial sequence
  WAS_Intron1_Off3_Adapter_REV
gtgctcttccgatctccaacgtgaccctttttgag

SEQ ID NO: 206 - DNA, 34 bp, Artificial sequence
  WAS_Intron2_Off1_Adapter_FOR
gcgttatcgaggtctcacagtctcttcccctgct

SEQ ID NO: 207 - DNA, 35 bp, Artificial sequence
  WAS_Intron2_Off1_Adapter_REV
gtgctcttccgatctcttggccagtgtctttccat

SEQ ID NO: 208 - DNA, 34 bp, Artificial sequence
  TAT_On_Adapter_FOR
gcgttatcgaggtctgtgtttggaaacctgccta

SEQ ID NO: 209 - DNA, 35 bp, Artificial sequence
  TAT_On_Adapter_REV
gtgctcttccgatctccaaatccaaaggaccatgt

SEQ ID NO: 210 - DNA, 34 bp, Artificial sequence
  TAT_Off1_Adapter_FOR
gcgttatcgaggtccatcccctggcatctagaaa

SEQ ID NO: 211 - DNA, 35 bp, Artificial sequence
  TAT_Off1_Adapter_REV
gtgctcttccgatcttcactacctggtggctatgg

SEQ ID NO: 212 - DNA, 34 bp, Artificial sequence
  FANCF_On_Adapter_FOR
gcgttatcgaggtcagcattgcagagaggcgtat

SEQ ID NO: 213 - DNA, 34 bp, Artificial sequence
  FANCF_On_Adapter_REV
gtgctcttccgatctatggatgtggcgcaggtag

SEQ ID NO: 214 - DNA, 34 bp, Artificial sequence
  FANCF_Off1_Adapter_FOR
gcgttatcgaggtccacagattgatgccactgga

SEQ ID NO: 215 - DNA, 35 bp, Artificial sequence
  FANCF_Off1_Adapter_REV
gtgctcttccgatctacgccagcactttctaagga

SEQ ID NO: 216 - DNA, 35 bp, Artificial sequence
  FANCF_Off2-3_Adapter_FOR
gcgttatcgaggtcttaccagatggaggacagtga

SEQ ID NO: 217 - DNA, 36 bp, Artificial sequence
  FANCF_Off2-3_Adapter_REV
gtgctcttccgatctaccagtttgagacctctgacc

SEQ ID NO: 218 - DNA, 34 bp, Artificial sequence
  FANCF_Off4_Adapter_FOR
gcgttatcgaggtcggctctgggtacagttctgc

SEQ ID NO: 219 - DNA, 35 bp, Artificial sequence
  FANCF_Off4_Adapter_REV
gtgctcttccgatctgccacagacgaagacacaga

SEQ ID NO: 220 - protein, 2041 aa, Artificial sequence
  #Cas9 variant 1
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTSESAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 221 - protein, 2033 aa, Artificial sequence
  #Cas9 variant 2
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSEGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 222 - protein, 2035 aa, Artificial sequence
  #Cas9 variant 3
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSGGSGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 223 - protein, 2040 aa, Artificial sequence
  #Cas9 variant 4
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGTSESATPESGGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 224 - protein, 2037 aa, Artificial sequence
  #Cas9 variant 5
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 225 - protein, 2037 aa, Artificial sequence
  #Cas9 variant 6
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASESATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 226 - protein, 2040 aa, Artificial sequence
  #Cas9 variant 7
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 227 - protein, 2042 aa, Artificial sequence
  #Cas9 variant 8
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTPGGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 228 - protein, 2036 aa, Artificial sequence
  #Cas9 variant 9
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGASGSKTPGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 229 - protein, 2033 aa, Artificial sequence
  #Cas9 variant 10
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 230 - protein, 2033 aa, Artificial sequence
  #Cas9 variant 11
APKKKRKVGIHGVPAATGPGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 231 - protein, 2042 aa, Artificial sequence
  #Cas9 variant 12
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTSEGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 232 - protein, 2036 aa, Artificial sequence
  #Cas9 variant 13
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 233 - protein, 2043 aa, Artificial sequence
  #Cas9 variant 14
APKKKRKVGIHGVPAATGPGGSAGDTTGPGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 234 - protein, 2040 aa, Artificial sequence
  #Cas9 variant 15
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASESATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 235 - protein, 2036 aa, Artificial sequence
  #Cas9 variant 16
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSEGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 236 - protein, 2029 aa, Artificial sequence
  #Cas9 variant 17
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 237 - protein, 2032 aa, Artificial sequence
  #Cas9 variant 18
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAASGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 238 - protein, 2033 aa, Artificial sequence
  #Cas9 variant 19
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 239 - protein, 2349 aa, Artificial sequence
  #Cas9 variant 20
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 240 - protein, 2357 aa, Artificial sequence
  #Cas9 variant 21
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 241 - protein, 2354 aa, Artificial sequence
  #Cas9 variant 22
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 242 - protein, 2345 aa, Artificial sequence
  #Cas9 variant 23
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 243 - protein, 2348 aa, Artificial sequence
  #Cas9 variant 24
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 244 - protein, 2673 aa, Artificial sequence
  #Cas9 variant 25
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 245 - protein, 2676 aa, Artificial sequence
  #Cas9 variant 26
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 246 - protein, 2670 aa, Artificial sequence
  #Cas9 variant 27
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 247 - protein, 2673 aa, Artificial sequence
  #Cas9 variant 28
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 248 - protein, 2670 aa, Artificial sequence
  #Cas9 variant 29
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 249 - protein, 2673 aa, Artificial sequence
  #Cas9 variant 30
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 250 - protein, 2036 aa, Artificial Sequence
  #Cas9 variant 1
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTSESAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 251 - protein, 2028 aa, Artificial Sequence
  #Cas9 variant 2
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSEGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 252 - protein, 2030 aa, Artificial Sequence
  #Cas9 variant 3
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSGGSGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 253 - protein, 2035 aa, Artificial Sequence
  #Cas9 variant 4
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGTSESATPESGGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 254 - protein, 2032 aa, Artificial Sequence
  #Cas9 variant 5
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 255 - protein, 2032 aa, Artificial Sequence
  #Cas9 variant 6
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASESATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 256 - protein, 2035 aa, Artificial Sequence
  #Cas9 variant 7
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 257 - protein, 2037 aa, Artificial Sequence
  #Cas9 variant 8
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTPGGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 258 - protein, 2031 aa, Artificial Sequence
  #Cas9 variant 9
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGASGSKTPGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 259 - protein, 2028 aa, Artificial Sequence
  #Cas9 variant 10
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 260 - protein, 2028 aa, Artificial Sequence
  #Cas9 variant 11
APKKKRKVGIHGVPAATGPGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 261 - protein, 2037 aa, Artificial Sequence
  #Cas9 variant 12
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTSEGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 262 - protein, 2031 aa, Artificial Sequence
  #Cas9 variant 13
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 263 - protein, 2038 aa, Artificial Sequence
  #Cas9 variant 14
APKKKRKVGIHGVPAATGPGGSAGDTTGPGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 264 - protein, 2035 aa, Artificial Sequence
  #Cas9 variant 15
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASESATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 265 - protein, 2031 aa, Artificial Sequence
  #Cas9 variant 16
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSEGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 266 - protein, 2024 aa, Artificial Sequence
  #Cas9 variant 17
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 267 - protein, 2027 aa, Artificial Sequence
  #Cas9 variant 18
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVSGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 268 - protein, 2028 aa, Artificial Sequence
  #Cas9 variant 19
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 269 - protein, 2349 aa, Artificial Sequence
  #Cas9 variant 20
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 270 - protein, 2352 aa, Artificial Sequence
  #Cas9 variant 21
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 271 - protein, 2349 aa, Artificial Sequence
  #Cas9 variant 22
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 272 - protein, 2340 aa, Artificial Sequence
  #Cas9 variant 23
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 273 - protein, 2343 aa, Artificial Sequence
  #Cas9 variant 24
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 274 - protein, 2668 aa, Artificial Sequence
  #Cas9 variant 25
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 275 - protein, 2671 aa, Artificial Sequence
  #Cas9 variant 26
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 276 - protein, 2665 aa, Artificial Sequence
  #Cas9 variant 27
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 277 - protein, 2668 aa, Artificial Sequence
  #Cas9 variant 28
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 278 - protein, 2665 aa, Artificial Sequence
  #Cas9 variant 29
APKKKRKVGIHGVPAATGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 279 - protein, 2668 aa, Artificial Sequence
  #Cas9 variant 30
APKKKRKVGIHGVPAATGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 280 - protein, 2008 aa, Artificial Sequence
  Cas9 variant 17 linkers
SRADPKKKRKVPRAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 281 - protein, 2012 aa, Artificial Sequence
  Cas9 variant 2 linkers
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSEGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 282 - protein, 2015 aa, Artificial Sequence
  Cas9 variant 9 linkers
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGASGSKTPGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 283 - protein, 2020 aa, Artificial Sequence
  Cas9 variant 1 linkers
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTSESAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 284 - protein, 2019 aa, Artificial Sequence
  Cas9 variant 5 linkers
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTGPGGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 285 - protein, 2016 aa, Artificial Sequence
  Cas9 variant 6 linkers
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASESATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 286 - protein, 2019 aa, Artificial Sequence
  Cas9 variant 4 linkers
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGTSESATPESGGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 287 - protein, 2014 aa, Artificial Sequence
  Cas9 variant 3 linkers
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSGGSGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 288 - protein, 2014 aa, Artificial Sequence
  Cas9 variant 11 linkers
SRADPKKKRKVTGPGPGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 289 - protein, 2026 aa, Artificial Sequence
  Cas9 variant 14 linkers
SRADPKKKRKVTGPGPGGSAGDTTGPGTGPGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 290 - protein, 2012 aa, Artificial Sequence
  Cas9 variant 19 linkers
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 291 - protein, 2015 aa, Artificial Sequence
  Cas9 variant 13 linkers
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 292 - protein, 2019 aa, Artificial Sequence
  Cas9 variant 15 linkers
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASESATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 293 - protein, 2016 aa, Artificial Sequence
  Cas9 variant 16 linkers
  misc_feature (1)..(1): Xaa can be any naturally occurring amino acid
XSRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSEGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 294 - protein, 2019 aa, Artificial Sequence
  Cas9 variant 7 linkers
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 295 - protein, 2036 aa, Artificial Sequence
  #Cas9 variant 1
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTSESAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 296 - protein, 2028 aa, Artificial Sequence
  #Cas9 variant 2
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSEGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 297 - protein, 2030 aa, Artificial Sequence
  #Cas9 variant 3
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSGGSGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 298 - protein, 2035 aa, Artificial Sequence
  #Cas9 variant 4
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGTSESATPESGGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 299 - protein, 2032 aa, Artificial Sequence
  #Cas9 variant 5
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 300 - protein, 2032 aa, Artificial Sequence
  #Cas9 variant 6
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASESATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 301 - protein, 2035 aa, Artificial Sequence
  #Cas9 variant 7
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 302 - protein, 2037 aa, Artificial Sequence
  #Cas9 variant 8
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTPGGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 303 - protein, 2031 aa, Artificial Sequence
  #Cas9 variant 9
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGASGSKTPGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 304 - protein, 2028 aa, Artificial Sequence
  #Cas9 variant 10
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 305 - protein, 2028 aa, Artificial Sequence
  #Cas9 variant 11
SRADPKKKRKVTGPGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 306 - protein, 2037 aa, Artificial Sequence
  #Cas9 variant 12
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTSEGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 307 - protein, 2031 aa, Artificial Sequence
  #Cas9 variant 13
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 308 - protein, 2038 aa, Artificial Sequence
  #Cas9 variant 14
SRADPKKKRKVTGPGGSAGDTTGPGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 309 - protein, 2035 aa, Artificial Sequence
  #Cas9 variant 15
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASESATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 310 - protein, 2031 aa, Artificial Sequence
  #Cas9 variant 16
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSEGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 311 - protein, 2024 aa, Artificial Sequence
  #Cas9 variant 17
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 312 - protein, 2027 aa, Artificial Sequence
  #Cas9 variant 18
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAASGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 313 - protein, 2028 aa, Artificial Sequence
  #Cas9 variant 19
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 314 - protein, 2349 aa, Artificial Sequence; identical to SEQ ID NO: 239
  #Cas9 variant 20

SEQ ID NO: 315 - protein, 2352 aa, Artificial Sequence
  #Cas9 variant 21
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 316 - protein, 2349 aa, Artificial Sequence
  #Cas9 variant 22
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 317 - protein, 2340 aa, Artificial Sequence
  #Cas9 variant 23
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 318 - protein, 2343 aa, Artificial Sequence
  #Cas9 variant 24
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 319 - protein, 2668 aa, Artificial Sequence
  #Cas9 variant 25
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 320 - protein, 2671 aa, Artificial Sequence
  #Cas9 variant 26
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 321 - protein, 2665 aa, Artificial Sequence
  #Cas9 variant 27
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 322 - protein, 2668 aa, Artificial Sequence
  #Cas9 variant 28
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 323 - protein, 2665 aa, Artificial Sequence
  #Cas9 variant 29
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 324 - protein, 2668 aa, Artificial Sequence
  #Cas9 variant 30
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPKKKRKVGIHGVPAAAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 325 - protein, 2031 aa, Artificial Sequence
  #Cas9 variant 1
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTSESAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 326 - protein, 2023 aa, Artificial Sequence
  #Cas9 variant 2
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSEGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 327 - protein, 2025 aa, Artificial Sequence
  #Cas9 variant 3
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSGGSGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 328 - protein, 2030 aa, Artificial Sequence
  #Cas9 variant 4
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGTSESATPESGGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 329 - protein, 2027 aa, Artificial Sequence
  #Cas9 variant 5
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 330 - protein, 2027 aa, Artificial Sequence
  #Cas9 variant 6
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASESATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 331 - protein, 2030 aa, Artificial Sequence
  #Cas9 variant 7
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 332 - protein, 2032 aa, Artificial Sequence
  #Cas9 variant 8
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTPGGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 333 - protein, 2026 aa, Artificial Sequence
  #Cas9 variant 9
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGASGSKTPGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 334 - protein, 2023 aa, Artificial Sequence
  #Cas9 variant 10
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 335 - protein, 2023 aa, Artificial Sequence
  #Cas9 variant 11
SRADPKKKRKVTGPGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 336 - protein, 2032 aa, Artificial Sequence
  #Cas9 variant 12
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTSEGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 337 - protein, 2026 aa, Artificial Sequence
  #Cas9 variant 13
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 338 - protein, 2033 aa, Artificial Sequence
  #Cas9 variant 14
SRADPKKKRKVTGPGGSAGDTTGPGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 339 - protein, 2030 aa, Artificial Sequence
  #Cas9 variant 15
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASESATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 340 - protein, 2026 aa, Artificial Sequence
  #Cas9 variant 16
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSEGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 341 - protein, 2019 aa, Artificial Sequence
  #Cas9 variant 17
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 342 - protein, 2022 aa, Artificial Sequence
  #Cas9 variant 18
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVSGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 343 - protein, 2023 aa, Artificial Sequence
  #Cas9 variant 19
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 344 - protein, 2344 aa, Artificial Sequence
  #Cas9 variant 20
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 345 - protein, 2347 aa, Artificial Sequence
  #Cas9 variant 21
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 346 - protein, 2344 aa, Artificial Sequence
  #Cas9 variant 22
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 347 - protein, 2335 aa, Artificial Sequence
  #Cas9 variant 23
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 348 - protein, 2338 aa, Artificial Sequence
  #Cas9 variant 24
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 349 - protein, 2663 aa, Artificial Sequence
  #Cas9 variant 25
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 350 - protein, 2656 aa, Artificial Sequence
  #Cas9 variant 26
  misc_feature (1)..(1): Xaa can be any naturally occurring amino acid
XTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 351 - protein, 2660 aa, Artificial Sequence
  #Cas9 variant 27
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 352 - protein, 2663 aa, Artificial Sequence
  #Cas9 variant 28
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 353 - protein, 2660 aa, Artificial Sequence
  #Cas9 variant 29
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 354 - protein, 2663 aa, Artificial Sequence
  #Cas9 variant 30
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 355 - protein, 2021 aa, Artificial Sequence
  Cas9 variant 12 linkers
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTSEGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 356 - protein, 2333 aa, Artificial Sequence
  Cas9 variant 22 linkers
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 357 - protein, 2336 aa, Artificial Sequence
  Cas9 variant 21 linkers
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 358 - protein, 2324 aa, Artificial Sequence
  Cas9 variant 23 linkers
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 359 - protein, 2327 aa, Artificial Sequence
  Cas9 variant 24 linkers
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 360 - protein, 2021 aa, Artificial Sequence
  Cas9 variant 8 linkers
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGSETPGTPGGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 361 - protein, 2649 aa, Artificial Sequence
  Cas9 variant 27 linkers
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 362 - protein, 2649 aa, Artificial Sequence
  Cas9 variant 30 linkers (iCas)
  misc_feature (2017)..(2017): Xaa can be any naturally occurring amino acid
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPRAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 363 - protein, 2652 aa, Artificial Sequence
  Cas9 variant 25 linkers
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 364 - protein, 2653 aa, Artificial Sequence
  Cas9 variant 28 linkers
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPGGPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 365 - protein, 2656 aa, Artificial Sequence
  Cas9 variant 26 linkers
SRADPKKKRKVTGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPGGPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 366 - protein, 2015 aa, Artificial Sequence
  Cas9 variant 10 linkers
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGPGGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 367 - protein, 2333 aa, Artificial Sequence
  Cas9 variant 20 linkers
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 368 - protein, 2649 aa, Artificial Sequence
  Cas9 variant 29 linkers
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGGSPRGGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATATPESGADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPAGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 369 - protein, 2011 aa, Artificial Sequence
  Cas9 variant 18 linkers
SRADPKKKRKVTGAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAGASGSDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 370 - protein, 8 aa, Artificial Sequence
  Peptide linker L^1
TGPGPGGS

SEQ ID NO: 371 - protein, 20 aa, Artificial Sequence
  Peptide linker L^1
TGPGPGGSAGDTTGPGTGPG

SEQ ID NO: 372 - protein, 5 aa, Artificial Sequence
  Peptide linker L^1
TGGGS

SEQ ID NO: 373 - protein, 5 aa, Artificial Sequence
  Peptide linker L^2
PRGGS

SEQ ID NO: 374 - protein, 8 aa, Artificial Sequence
  Peptide linker L^2
GGSPRGGS

SEQ ID NO: 375 - protein, 9 aa, Artificial Sequence
  Peptide linker L^2
TPGGPRGGS

SEQ ID NO: 376 - protein, 6 aa, Artificial Sequence
  Peptide linker L^3
SGSEGA

SEQ ID NO: 377 - protein, 9 aa, Artificial Sequence
  Peptide linker L^3
GASGSKTPG

SEQ ID NO: 378 - protein, 14 aa, Artificial Sequence
  Peptide linker L^3
SGSETPGTSESAGA

SEQ ID NO: 379 - protein, 13 aa, Artificial Sequence
  Peptide linker L^3
SGSETPGTGPGGA

SEQ ID NO: 380 - protein, 10 aa, Artificial Sequence
  Peptide linker L^3
SESATPESGA

SEQ ID NO: 381 - protein, 13 aa, Artificial Sequence
  Peptide linker L^3
GTSESATPESGGA

SEQ ID NO: 382 - protein, 8 aa, Artificial Sequence
  Peptide linker L^3
GGSGGSGA

SEQ ID NO: 383 - protein, 4 aa, Artificial Sequence
  Peptide linker L^3 or L^4
GGGS

SEQ ID NO: 384 - protein, 6 aa, Artificial Sequence
  Peptide linker L^3
TPESGA

SEQ ID NO: 385 - protein, 10 aa, Artificial Sequence
  Peptide linker L^3
SGSETPGTGA

SEQ ID NO: 386 - protein, 12 aa, Artificial Sequence
  Peptide linker L^3
SGSETPGTSEGA

SEQ ID NO: 387 - protein, 6 aa, Artificial Sequence
  Peptide linker L^3 or L^5
PAGGGS

SEQ ID NO: 388 - protein, 12 aa, Artificial Sequence
  Peptide linker L^3
SGSETPGTPGGA

SEQ ID NO: 389 - protein, 9 aa, Artificial Sequence
  Peptide linker L^3
TPESGPGGA

SEQ ID NO: 390 - protein, 5 aa, Artificial Sequence
  Peptide linker L^3
GASGS

SEQ ID NO: 391 - protein, 6 aa, Artificial Sequence
  Peptide linker L^1
TGPGGS

SEQ ID NO: 392 - protein, 16 aa, Artificial Sequence
  Peptide linker L^3
TGPGGSAGDTTGPGGS

SEQ ID NO: 393 - protein, 7 aa, Artificial Sequence
  localization sequence
PKKKRKV

SEQ ID NO: 394 - protein, 16 aa, Artificial Sequence
  localization sequence
KRPAATKKAGQAKKKK

SEQ ID NO: 395 - protein, 13 aa, Artificial Sequence
  localization sequence
CGGGPKKKRKVED

SEQ ID NO: 396 - protein, 9 aa, Artificial Sequence
  localization sequence
PAAKRVKLD

SEQ ID NO: 397 - protein, 20 aa, Artificial Sequence
  localization sequence
AVKRPAATKKAGQAKKKKLD

SEQ ID NO: 398 - protein, 25 aa, Artificial Sequence
  localization sequence
MSRRRKANPTKLSENAKKLAKEVEN

SEQ ID NO: 399 - protein, 9 aa, Artificial Sequence
  localization sequence
KLKIKRPVK

What is claimed is:

1. An endonuclease-based gene editing fusion protein construct, wherein the fusion protein construct comprises the following components:
   (a) a CRISPR-associated endonuclease or a derivative thereof; and
   (b) at least two hormone binding domain of the estrogen receptor (ERT2) comprising SEQ ID NO: 4 or derivatives thereof capable of ligand binding; and
   (c) two or more selected from the group consisting of a localization sequence, a binding tag, a self-cleaving peptide, and a selectable marker;
   wherein said construct comprises formula (I):

$$A \xrightarrow{L^6} B \xrightarrow{L^1} C_1 \xrightarrow{L^2} C_2 \xrightarrow{L^3} X \xrightarrow{L^4} D \xrightarrow{L^5} E \xrightarrow{L^7} F \xrightarrow{L^8} G; \quad (I)$$

wherein A is absent or is the hormone binding domain of the estrogen receptor (ERT2) or the derivatives thereof, or a binding tag;
   wherein B is a localization sequence or derivatives thereof, or a binding tag, or absent;
   wherein both $C_1$ and $C_2$ are present or only $C_1$ is present; wherein $C_1$ and $C_2$ are each independently selected from the group consisting of a localization sequence, derivatives thereof of the localization sequence, and the hormone binding domain of the estrogen receptor (ERT2) of (b) or the derivatives thereof;
   wherein X is a CRISPR-associated endonuclease or a derivative thereof;
   wherein D is selected from the group consisting of the hormone binding domain of the estrogen receptor (ERT2) of (b) or the derivatives thereof, a localization sequence and derivatives of the localization sequence;
   wherein E is absent or is selected from the group consisting of the hormone binding domain of the estrogen receptor (ERT2) of (b) or the derivatives thereof and a self-cleaving peptide;
   wherein F is absent or is selected from the group consisting of a self-cleaving peptide and a selectable marker;
   wherein G is absent or is a selectable marker;
   wherein $L^1$, $L^2$, $L^3$, $L^4$, $L^5$, $L^6$, $L^7$ and $L^8$ are linker sequences and at least one of the linker sequences is present and each of the linkers sequences is independently between 1 to 25 amino acids long;
   wherein, if any one or more of the linker sequences of $L^1$ to $L^8$ is absent, the neighbouring substituents are bound by a peptide bond;
   wherein $L^1$ is selected from the group consisting of PR, TG, TGPGPGGS (SEQ ID NO: 370), TGPGPGGSAGDTTGPGTGPG (SEQ ID NO: 371) and TGGGS (SEQ ID NO: 372);
   wherein $L^2$ is selected from the group consisting of PRGGS (SEQ ID NO: 373), GGSPRGGS (SEQ ID NO: 374), PR, and TPGGPRGGS (SEQ ID NO: 375);
   wherein $L^3$ is selected from the group consisting of PG, SGSEGA (SEQ ID NO: 376), GASGSKTPG (SEQ ID NO: 377), SGSETPGTSESAGA (SEQ ID NO: 378), SGSETPGTGPGGA (SEQ ID NO: 379), SESATPESGA (SEQ ID NO: 380), GTSESATPESGGA (SEQ ID NO: 381), GGSGGSGA (SEQ ID NO: 382), GA, GGGS (SEQ ID NO: 383), TPESGA (SEQ ID NO: 384), SGSETPGTGA (SEQ ID NO: 385), SGSETPGT-SEGA SEQ ID NO: 386), PAG, PAGGGS (SEQ ID NO: 387), SGSETPGTPGGA (SEQ ID NO: 388), TPESGPGGA (SEQ ID NO: 389) and GASGS (SEQ ID NO: 390);
   wherein $L^4$ is GGGS (SEQ ID NO: 383);
   wherein $L^5$ is PAG or PAGGGS (SEQ ID NO: 387);
   wherein $L^6$ is GA;
   wherein $L^7$ and $L^8$ are independently selected from the linkers as disclosed in any of $L^1$ to $L^6$.

2. The construct of claim 1, wherein
   i) D and E are each one hormone binding domain of the estrogen receptor (ERT2) of (b) or the derivatives thereof;
   ii) A is a mutated hormone binding domain of the estrogen receptor (ERT2) of (b) or the derivative thereof, B is a binding tag, $C_1$ is a localization sequence and $C_2$ is absent, X is a CRISPR-associated endonuclease or derivative thereof, D is a localization sequence, E is a hormone binding domain of the estrogen receptor (ERT2) of (b) or the derivative thereof, F is a self-cleaving peptide and G is a selectable marker;
   iii) wherein A is a binding tag, B is a localization sequence, $C_1$ is the hormone binding domain of the estrogen receptor (ERT2) of (b) of the derivative thereof and $C_2$ is absent, X is the CRISPR-associated endonuclease or derivative thereof, D is the localization sequence, E is the hormone binding domain of the estrogen receptor (ERT2) of (b) or the derivative thereof, F is a self-cleaving peptide and G is a selectable marker.

3. An endonuclease-based gene editing fusion protein construct, wherein the fusion protein construct comprises the following components:
   (a) a CRISPR-associated endonuclease or a derivative thereof; and
   (b) at least two hormone binding domain of the estrogen receptor (ERT2) comprising SEQ ID NO: 4 or derivatives thereof capable of ligand binding; and
   (c) two or more selected from the group consisting of a localization sequence, a binding tag, a self-cleaving peptide, and a selectable marker;

wherein said construct comprises formula (II):

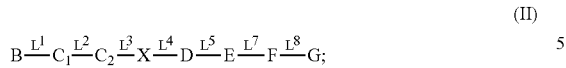
(II)

wherein B is a localization sequence or derivatives thereof, or a binding tag;
wherein both $C_1$ and $C_2$ are present or only $C_1$ is present; wherein $C_1$ and $C_2$ are each independently selected from the group consisting of a localization sequence, derivatives thereof of the localization sequence, and the hormone binding domain of the estrogen receptor (ERT2) of (b) or the derivatives thereof;
wherein X is a CRISPR-associated endonuclease or a derivative thereof,
wherein D is selected from the group consisting of the hormone binding domain of the estrogen receptor (ERT2) or the derivatives thereof, a localization sequence and derivatives of the localization sequence;
wherein E is absent or is selected from the group consisting of the hormone binding domain of the estrogen receptor (ERT2) or the derivatives thereof and a self-cleaving peptide;
wherein F is absent or is selected from the group consisting of a self-cleaving peptide and a selectable marker;
wherein G is absent or is a selectable marker;
wherein $L^1$, $L^2$, $L^3$, $L^4$, $L^5$, $L^7$ and $L^8$ are linker sequences; wherein at least one of the linker sequences is present and each of the linkers sequences is independently between 1 to 25 amino acids long;
wherein, if any one or more of the linker sequences of $L^1$ to $L^8$ is absent, the neighbouring substituents are bound by a peptide bond;
wherein $L^1$ is selected from the group consisting of PR, TG, TGPGPGGS (SEQ ID NO: 370), TGPGPGGSAGDTTGPGTGPG (SEQ ID NO: 371) and TGGGS (SEQ ID NO: 372);
wherein $L^2$ is selected from the group consisting of PRGGS (SEQ ID NO: 373), GGSPRGGS (SEQ ID NO: 374), PR, and TPGGPRGGS (SEQ ID NO: 375);
wherein $L^3$ is selected from the group consisting of PG, SGSEGA (SEQ ID NO: 376), GASGSKTPG (SEQ ID NO: 377), SGSETPGTSESAGA (SEQ ID NO: 378), SGSETPGTGPGGA (SEQ ID NO: 379), SESATPESGA (SEQ ID NO: 380), GTSESATPESGGA (SEQ ID NO: 381), GGSGGSGA (SEQ ID NO: 382), GA, GGGS (SEQ ID NO: 383), TPESGA (SEQ ID NO: 384), SGSETPGTGA (SEQ ID NO: 385), SGSETPGTSEGA SEQ ID NO: 386), PAG, PAGGGS (SEQ ID NO: 387), SGSETPGTPGGA (SEQ ID NO: 388), TPESGPGGA (SEQ ID NO: 389) and GASGS (SEQ ID NO: 390);
wherein $L^4$ is GGGS (SEQ ID NO: 383);
wherein $L^5$ and $L^7$ are independently PAG, SGS or PAGGGS (SEQ ID NO: 387);
wherein $L^8$ is selected from the linkers as disclosed in any of $L^1$ to $L^5$ and $L^7$.

4. The construct of claim 3, wherein
i) D is a localization sequence and E and F are each a mutated hormone binding domain of the estrogen receptor (ERT2) of (b) or the derivatives thereof;
ii) A is absent, B is localization sequence, $C_1$ is the hormone binding domain of the estrogen receptor (ERT2) of (b) of the derivative thereof, $C_2$ is absent, X is a CRISPR-associated endonuclease or a derivative thereof, D is localization sequence, E is a hormone binding domain of the estrogen receptor (ERT2) of (b) or the derivative thereof and F is absent;
iii) B is a localization sequence, $C_1$ is a hormone binding domain of the estrogen receptor (ERT2) of (b) or the derivative thereof, $C_2$ is absent, X is a CRISPR-associated endonuclease or a derivative thereof, D is a localization sequence and E and F are both each a hormone binding domain of the estrogen receptor (ERT2) of (b) or the derivatives thereof; or
iv) B is a localization sequence, $C_1$ and $C_2$ are each independently a mutated hormone binding domain of the estrogen receptor (ERT2) of (b) or the derivative thereof, X is a CRISPR-associated endonuclease or a derivative thereof, D is localization sequence and E and F are both each a hormone binding domain of the estrogen receptor (ERT2) of (b) or the derivative thereof.

5. The construct of claim 1 or 3, wherein the CRISPR-associated endonuclease, or derivative thereof, is selected from the group consisting of a wild type CRISPR-associated protein 9 (Cas9), a mutated CRISPR-associated protein 9 (Cas9), wherein the mutated CRISPR-associated protein 9 (Cas9) is functional; a wild type Cpf1 protein, and a mutated Cpf1 protein, wherein the mutated Cpf1 protein is functional.

6. The construct of claim 5, wherein
a) the CRISPR-associated protein 9 (Cas9), or derivative thereof, is selected from the group consisting of *Streptococcus pyogenes, Streptococcus thermophiles, Listeria innocua, Staphylococcus aureus* and *Neisseria meningitidis;*
b) the CRISPR-associated protein 9 (Cas9), or derivative thereof, has at least 95% sequence identity to SEQ ID NO: 1;
c) the Cpf1 protein, or derivative thereof, is selected from the group consisting of *Acidaminococcus*, Lachnospiraceae, Parcubacteria, *Butyrivibrio proteoclasticus*, Peregrinibacteria, *Porphyromonas crevioricanis, Prevotella disiens, Moraxella bovoculi, Smithella, Leptospira inadai, Francisella novicida, Candidatus Methanoplasma termitum* and *Eubacterium eligens*; or
d) the Cpf1 protein, or derivative thereof, has at least 95% sequence identity to SEQ ID NO: 2 or 3.

7. The construct of claim 1 or 3, wherein
a) the localization sequence is selected from the group consisting of nuclear localization sequence, mitochondrial localization sequence and derivatives thereof, optionally wherein the at least one or more nuclear localization sequences (NLS) are selected from the group consisting of Simian Vacuolating Virus 40 (SV40) Large T-antigen, Nucleoplasmin, Importin α, EGL-13, c-MYC, TUS, AR, PLSCR1, PEP, TPX2, RB, TP53, NIN2, PB2, CBP80, SRY, hnRNP A1, HRP1, Borna Disease Virus p10, Ty1 Integrase, and the Chelsky consensus sequence;
b) at least one or more nuclear localization sequences (NLS) are monopartite or bipartite NLS; or
c) at least one or more nuclear localization sequences (NLS) are classical NLS (cNLS) or proline-tyrosine (PY)-NLS.

8. The construct of claim 1 or 3, wherein the binding tag is located at either the N-terminus or the C-terminus of the construct, or at both ends of the construct.

9. The construct of claim 1 or 3, wherein the binding tag is selected from the group consisting of a V5 epitope tag, a FLAG tag, a tandem FLAG-tag, a triple FLAG tag (3×FLAG), a Human influenza hemagglutinin (HA) tag, a tandem HA tag, a triple HA tag (3×HA), a sextuple Histidine tag (6×HIS), biotin, c-MYC, a Glutathione-S-transferase (GST) tag, a Strep-tag, a Strep-tag II, a S-tag, a natural histidine affinity tag (HAT), a Calmodulin-binding peptide (CBP) tag, a Streptavidin-binding peptide (SBP) tag, a Chitin-binding domain, a Maltose-binding protein (MBP) and derivatives thereof.

10. The construct of claim 9, wherein the V5 epitope tag sequence is SEQ ID NO: 12 or a derivative thereof.

11. The construct of claim 1 or 3, wherein the self-cleaving peptide is a 2A self-cleaving peptide or a derivative thereof.

12. The construct of claim 11, wherein the 2A self-cleaving peptide is SEQ ID NO: 13 or a derivative thereof.

13. The construct of claim 1 or 3, wherein the construct has at least 95% sequence identity to any of SEQ ID NO: 16-30 or at least 90% sequence identity to any of SEQ ID NO: 15, 31-44.

14. The construct of claim 1 or 3, wherein the construct has an amino acid sequence selected from the group consisting of SEQ ID NO: 37, SEQ ID NO: 74 and SEQ ID NO: 249.

* * * * *